(12) United States Patent
Wawrzyn et al.

(10) Patent No.: US 10,696,991 B2
(45) Date of Patent: Jun. 30, 2020

(54) NEPETALACTOL OXIDOREDUCTASES, NEPETALACTOL SYNTHASES, AND MICROBES CAPABLE OF PRODUCING NEPETALACTONE

(71) Applicant: Zymergen Inc., Emeryville, CA (US)

(72) Inventors: Grayson Wawrzyn, Oakland, CA (US); Christine Roche, Emeryville, CA (US); Patrick J. Westfall, Emeryville, CA (US); Warren Lau, Emeryville, CA (US); Savita Ganesan, Emeryville, CA (US); Fern R. McSorley, Emeryville, CA (US); Zach Serber, Emeryville, CA (US)

(73) Assignee: Zymergen Inc., Emeryville, CA (US)

(*) Notice: Subject to any disclaimer, the term of this patent is extended or adjusted under 35 U.S.C. 154(b) by 0 days.

(21) Appl. No.: 16/534,981

(22) Filed: Aug. 7, 2019

(65) Prior Publication Data

US 2019/0390237 A1    Dec. 26, 2019

Related U.S. Application Data

(63) Continuation of application No. PCT/US2018/067333, filed on Dec. 21, 2018.

(60) Provisional application No. 62/669,919, filed on May 10, 2018, provisional application No. 62/609,279, filed on Dec. 21, 2017, provisional application No. 62/609,272, filed on Dec. 21, 2017.

(51) Int. Cl.
*C12P 17/06* (2006.01)
*C12N 9/00* (2006.01)
*C12N 15/52* (2006.01)
*C12N 9/04* (2006.01)
*C12N 9/02* (2006.01)

(52) U.S. Cl.
CPC .......... *C12P 17/06* (2013.01); *C12N 9/001* (2013.01); *C12N 9/0006* (2013.01); *C12N 15/52* (2013.01); *C12Y 101/01324* (2015.07); *C12Y 103/01* (2013.01)

(58) Field of Classification Search
None
See application file for complete search history.

(56) References Cited

U.S. PATENT DOCUMENTS

| | | | |
|---|---|---|---|
| 5,753,507 | A | 5/1998 | Ohta et al. |
| 6,242,227 | B1 | 6/2001 | Millis et al. |
| 6,284,506 | B1 | 9/2001 | Hoshino et al. |
| 6,524,811 | B1 | 2/2003 | Cunningham et al. |
| 6,531,303 | B1 | 3/2003 | Millis et al. |
| 6,558,915 | B1 | 5/2003 | Tao |
| 6,586,202 | B2 | 7/2003 | Hoshino et al. |
| 6,806,076 | B1 | 10/2004 | Miyake et al. |
| 6,916,972 | B2 | 7/2005 | Falco et al. |
| 6,989,257 | B2 | 1/2006 | Berry et al. |
| 7,067,677 | B2 | 6/2006 | Manzer |
| 7,067,678 | B2 | 6/2006 | Scialdone |
| 7,122,341 | B1 | 10/2006 | Liao |
| 7,129,392 | B2 | 10/2006 | Hahn et al. |
| 7,132,250 | B2 | 11/2006 | Tao |
| 7,132,268 | B2 | 11/2006 | Miyake et al. |
| 7,135,622 | B2 | 11/2006 | Falco et al. |
| 7,172,886 | B2 | 2/2007 | Keasling et al. |
| 7,183,089 | B2 | 2/2007 | Keasling et al. |
| 7,192,751 | B2 | 3/2007 | Keasling et al. |
| 7,195,887 | B2 | 3/2007 | Cahoon et al. |
| 7,208,298 | B2 | 4/2007 | Miyake et al. |
| 7,217,863 | B2 | 5/2007 | Famodu et al. |
| 7,232,679 | B2 | 6/2007 | Berry et al. |
| 7,282,359 | B2 | 10/2007 | Cahoon et al. |
| 7,364,885 | B2 | 4/2008 | Miyake et al. |
| 7,422,884 | B2 | 9/2008 | Bai et al. |
| 7,531,333 | B2 | 5/2009 | Miyake et al. |
| 7,547,793 | B2 | 6/2009 | Hallahan et al. |
| 7,572,609 | B2 | 8/2009 | Berry et al. |
| 7,618,819 | B2 | 11/2009 | Kuehnle |
| 7,622,282 | B2 | 11/2009 | Keasling et al. |
| 7,622,283 | B2 | 11/2009 | Keasling et al. |
| 7,659,097 | B2 | 2/2010 | Renninger et al. |
| 7,667,017 | B2 | 2/2010 | Keasling et al. |
| 7,670,825 | B2 | 3/2010 | Keasling et al. |
| 7,704,716 | B2 | 4/2010 | Pichersky et al. |

(Continued)

FOREIGN PATENT DOCUMENTS

| | | |
|---|---|---|
| EP | 1115849 B1 | 2/2006 |
| EP | 1392824 B1 | 8/2008 |

(Continued)

OTHER PUBLICATIONS

U.S. Notice of Allowance dated Sep. 13, 2019 issued in U.S. Appl. No. 16/450,780.

(Continued)

*Primary Examiner* — Suzanne M Noakes

(74) *Attorney, Agent, or Firm* — Emily M. Haliday; Weaver Austin Villeneuve & Sampson LLP

(57) ABSTRACT

The present disclosure provides isolated nepetalactone oxidoreductase polypeptides (NORs), nepetalactol synthases (NEPSs), and related polynucleotides, engineered host cells, and cultures, as well as methods for producing NORs and NEPSs, and for using them to produce nepetalactol, nepetalactone, and dihydronepetalactone. The present disclosure also provides methods for engineering cells (e.g., microbial cells) to produce nepetalactone from a fermentation substrate such as glucose, as well as engineered cells having this capability and related cultures and methods for producing nepetalactone.

7 Claims, 10 Drawing Sheets

Specification includes a Sequence Listing.

(56) References Cited

U.S. PATENT DOCUMENTS

| | | |
|---|---|---|
| 7,718,417 B2 | 5/2010 | Millis et al. |
| 7,732,161 B2 | 6/2010 | Millis et al. |
| 7,736,881 B2 | 6/2010 | Poulter et al. |
| 7,736,882 B2 | 6/2010 | Keasling et al. |
| 7,741,070 B2 | 6/2010 | Stephanopoulos et al. |
| 7,838,279 B2 | 11/2010 | Millis et al. |
| 7,842,497 B2 | 11/2010 | Millis et al. |
| 7,842,855 B2 | 11/2010 | Cahoon et al. |
| 7,915,026 B2 | 3/2011 | Keasling et al. |
| 7,927,861 B2 | 4/2011 | Millis et al. |
| 7,927,862 B2 | 4/2011 | Millis et al. |
| 8,048,658 B2 | 11/2011 | Clark et al. |
| 8,097,438 B2 | 1/2012 | Chang et al. |
| 8,114,645 B2 | 2/2012 | Pitera et al. |
| 8,124,375 B2 | 2/2012 | Pichersky et al. |
| 8,158,383 B2 | 4/2012 | Keasling et al. |
| 8,173,410 B2 | 5/2012 | Bott et al. |
| 8,206,957 B2 | 6/2012 | Schädler et al. |
| 8,236,552 B2 | 8/2012 | Millis et al. |
| 8,241,888 B2 | 8/2012 | Millis et al. |
| 8,257,957 B2 | 9/2012 | Keasling et al. |
| 8,288,147 B2 | 10/2012 | Keasling et al. |
| 8,288,148 B2 | 10/2012 | Cervin et al. |
| 8,309,323 B2 | 11/2012 | Martin et al. |
| 8,338,155 B2 | 12/2012 | Bai et al. |
| 8,361,762 B2 | 1/2013 | Beck et al. |
| 8,415,136 B1 | 4/2013 | Gardner et al. |
| 8,461,322 B2 | 6/2013 | Cahoon et al. |
| 8,476,049 B2 | 7/2013 | McAuliffe et al. |
| 8,512,988 B2 | 8/2013 | Ajikumar et al. |
| 8,552,210 B2 | 10/2013 | Jackson et al. |
| 8,558,015 B2 | 10/2013 | Fisher et al. |
| 8,603,800 B2 | 12/2013 | Gardner et al. |
| 8,709,785 B2 | 4/2014 | Cervin et al. |
| 8,765,403 B2 | 7/2014 | Dueber et al. |
| 8,765,975 B2 | 7/2014 | Hutchenson et al. |
| 8,771,718 B2 | 7/2014 | Scialdone et al. |
| 8,815,548 B2 | 8/2014 | Beck et al. |
| 8,828,684 B2 | 9/2014 | Keasling et al. |
| 8,841,114 B2 | 9/2014 | Lang et al. |
| 8,859,261 B2 | 10/2014 | Gardner et al. |
| 8,951,764 B2 | 2/2015 | Bergsma et al. |
| 8,956,833 B2 | 2/2015 | Swartz et al. |
| 8,986,965 B2 | 3/2015 | McDaniel et al. |
| 8,987,433 B2 | 3/2015 | Mendez et al. |
| 8,993,305 B2 | 3/2015 | Beck et al. |
| 8,999,682 B2 | 4/2015 | Hahn et al. |
| 9,051,587 B2 | 6/2015 | Raab et al. |
| 9,102,954 B2 | 8/2015 | Millis et al. |
| 9,200,296 B2 | 12/2015 | Renninger et al. |
| 9,260,727 B2 | 2/2016 | Cervin et al. |
| 9,382,553 B2 | 7/2016 | Kirby et al. |
| 9,382,554 B2 | 7/2016 | Kallas et al. |
| 9,518,282 B2 | 12/2016 | Ono et al. |
| 9,521,844 B2 | 12/2016 | Fisher et al. |
| 9,670,518 B2 | 6/2017 | Meadows |
| 9,688,652 B2 | 6/2017 | Jackson et al. |
| 9,765,363 B1 | 9/2017 | Renninger |
| 9,809,829 B2 | 11/2017 | Keasling et al. |
| 9,834,800 B2 | 12/2017 | Tange et al. |
| 9,909,146 B2 | 3/2018 | Marliere |
| 10,106,822 B2 | 10/2018 | Renninger et al. |
| 2002/0035058 A1 | 3/2002 | Brown et al. |
| 2002/0119546 A1 | 8/2002 | Falco et al. |
| 2002/0197696 A1 | 12/2002 | Levin et al. |
| 2003/0115634 A1 | 6/2003 | Jomaa et al. |
| 2004/0010815 A1 | 1/2004 | Lange et al. |
| 2005/0287655 A1 | 12/2005 | Tabata et al. |
| 2006/0068393 A1 | 3/2006 | Lacour et al. |
| 2008/0233623 A1 | 9/2008 | Chang et al. |
| 2008/0261280 A1 | 10/2008 | Hahn et al. |
| 2009/0004724 A1 | 1/2009 | Keasling et al. |
| 2009/0053797 A1 | 2/2009 | Shiba et al. |
| 2009/0253174 A1 | 10/2009 | Serber et al. |
| 2010/0178679 A1 | 7/2010 | Anthony et al. |
| 2010/0184178 A1 | 7/2010 | Beck et al. |
| 2010/0311065 A1 | 12/2010 | Udersax et al. |
| 2010/0311136 A1 | 12/2010 | Yoneda et al. |
| 2011/0129883 A1 | 6/2011 | Jomaa et al. |
| 2011/0195470 A1 | 8/2011 | Millis et al. |
| 2011/0287476 A1 | 11/2011 | Renninger et al. |
| 2012/0083020 A1 | 4/2012 | Hahn et al. |
| 2012/0288891 A1 | 11/2012 | Meadows |
| 2013/0137138 A1 | 5/2013 | Hansen |
| 2013/0203132 A1 | 8/2013 | Hahn et al. |
| 2013/0273625 A1 | 10/2013 | Chotani et al. |
| 2013/0276166 A1 | 10/2013 | Hugueney et al. |
| 2013/0323820 A1 | 12/2013 | Chen et al. |
| 2014/0273144 A1 | 9/2014 | Hawkins et al. |
| 2014/0335576 A1 | 11/2014 | Chotani et al. |
| 2014/0370595 A1 | 12/2014 | Dueber et al. |
| 2015/0024009 A1 | 1/2015 | Lang et al. |
| 2015/0087042 A1 | 3/2015 | Keasling et al. |
| 2015/0093797 A1 | 4/2015 | Gardner et al. |
| 2015/0191747 A1 | 7/2015 | Chen et al. |
| 2015/0203873 A1 | 7/2015 | Beck et al. |
| 2015/0203880 A1 | 7/2015 | Stephanopoulos et al. |
| 2015/0225743 A1 | 8/2015 | Donaldson et al. |
| 2015/0225744 A1 | 8/2015 | Beck et al. |
| 2015/0259705 A1 | 9/2015 | Huembelin et al. |
| 2015/0275233 A1 | 10/2015 | Mihara et al. |
| 2015/0299732 A1 | 10/2015 | Millis et al. |
| 2015/0315599 A1 | 11/2015 | Shetty et al. |
| 2016/0032323 A1 | 2/2016 | Beck et al. |
| 2016/0040190 A1 | 2/2016 | Renninger et al. |
| 2016/0068831 A1 | 3/2016 | Beck et al. |
| 2016/0177341 A1 | 6/2016 | Chua et al. |
| 2016/0186168 A1 | 6/2016 | Konieczka et al. |
| 2016/0194674 A1 | 7/2016 | Bromann et al. |
| 2018/0030481 A1 | 2/2018 | Keasling et al. |
| 2018/0080054 A1 | 3/2018 | Ostergaard et al. |
| 2018/0171341 A1 | 6/2018 | Chua et al. |
| 2018/0186841 A1 | 7/2018 | Chua et al. |
| 2019/0338259 A1 | 11/2019 | Tracewell et al. |

FOREIGN PATENT DOCUMENTS

| | | |
|---|---|---|
| EP | 1641931 B1 | 11/2008 |
| EP | 1631664 B1 | 3/2009 |
| EP | 0769551 B1 | 5/2009 |
| EP | 1135471 B1 | 5/2009 |
| EP | 1987147 B1 | 7/2010 |
| EP | 1824969 B1 | 3/2011 |
| EP | 1765418 B1 | 12/2011 |
| EP | 2100963 B1 | 12/2011 |
| EP | 2182072 B1 | 12/2012 |
| EP | 1072683 B1 | 8/2013 |
| EP | 2707475 B1 | 9/2015 |
| EP | 2066778 B1 | 1/2016 |
| EP | 2024504 B1 | 2/2016 |
| EP | 2681313 B1 | 4/2016 |
| WO | WO/1999/058649 A1 | 11/1999 |
| WO | WO/2000/044912 A1 | 8/2000 |
| WO | WO/2000/078935 A1 | 12/2000 |
| WO | WO/2008/008256 A2 | 1/2008 |
| WO | WO/2009/005704 A1 | 1/2009 |
| WO | WO/2009/126623 A2 | 10/2009 |
| WO | WO/2010/141452 A1 | 12/2010 |
| WO | WO/2012/016172 A2 | 2/2012 |
| WO | WO/2012/016177 A2 | 2/2012 |
| WO | WO/2012/135591 A2 | 10/2012 |
| WO | WO/2013/096863 A1 | 6/2013 |
| WO | WO/2014/052054 A1 | 4/2014 |
| WO | WO/2014/066892 A1 | 5/2014 |
| WO | WO/2016/008885 A1 | 1/2015 |
| WO | WO/2015/030681 A1 | 3/2015 |
| WO | WO/2015/100180 A1 | 7/2015 |
| WO | WO/2015/127305 A2 | 8/2015 |
| WO | WO/2015/189428 A1 | 12/2015 |
| WO | WO/2016/008883 A1 | 1/2016 |
| WO | WO/2016/044713 A1 | 3/2016 |
| WO | WO/2016/108236 A1 | 7/2016 |
| WO | WO/2018/005935 A1 | 1/2018 |

(56) References Cited

FOREIGN PATENT DOCUMENTS

| WO | WO/2018/111194 A1 | 6/2018 |
|----|-------------------|--------|
| WO | WO/2019/113387 A1 | 6/2019 |
| WO | WO/2019/126778 A1 | 6/2019 |

OTHER PUBLICATIONS

PCT International Search Report and Written Opinion dated Feb. 26, 2019 issued in PCT/US2018/067333.
PCT International Search Report and Written Opinion dated Mar. 1, 2019 issued in PCT/US2018/064351.
Alagna, et al. (2012) "Olive phenolic compounds: metabolic and transcriptional profiling during fruit development" *BMC PlantBiology* 12(1): 162 (19 pages).
Billingsley, et al. (2017) "Engineering the biocatalytic selectivity of iridoid production in *Saccharomyces cerevisiae*." *Metab Eng* 44: p. 117-125. [HHS Public Access—Author manuscript—21 pages].
Brown, et al. (2015) "De novo production of the plant-derived alkaloid strictosidine in yeast" *PNAS* 112(11): 3205-3210.
Campell, et al. (2016) "Engineering of a Nepetalactol-Producing Platform Strain of *Saccharomyces cerevisiae* for the Production of Plant Seco-Iridoids," *ACS Synth Biol.* 5(5):405-14.
Crowley, et al. (1998) "A mutation in a purported regulatory gene affects control of sterol uptake in *Saccharomyces cerevisiae*." *J Bacteriol* 180(16): 4177-83.
Dewick (2002) "The biosynthesis of C5—C25 terpenoid compounds," *Nat Prod Rep.* 19(2):181-222.
Dimster-Denk, et al. (1994) "Feedback regulation of 3-hydroxy-3-methylglutaryl coenzyme a reductase in *Saccharomyces cerevisiae*." *Mol Biol Cell* 5(6): 655-65.
Geu-Flores, et al. (2012) "An alternative route to cyclic terpenes by reductive cyclization in iridoid biosynthesis" *Nature* 492(7427): 138-142.
GreatBay_China (2018) "Project: Nepetalactol Synthesis" Retrieved from the Internet: URL: http://2018.igem.org/wiki/images/f/fd/T—GreatBay_China—notebook_nepetalactol.pdf [retrieved on Feb. 13, 2019] 67 pages.
Hallahan, et al. (1998) "Nepetalactol oxidoreductase in trichomes of the catmint Nepeta racemose," *Phytochemistry* 48(3): 421-427.
Hofer, et al. (2013) "Geraniol hydroxylase and hydroxygeraniol oxidase activities of the CYP76 family of cytochrome P450 enzymes and potential for engineering the early steps of the (seco)iridoid pathway" *Metabolic Engineering* 20: 221-232.
Kanehisa, et al. (2000) "KEGG: kyoto encyclopedia of genes and genomes." *Nucleic Acids Res* 28(1): 27-30.
Krithika, et al. (2015) "Characterization of 10-hydroxygeraniol dehydrogenase from Catharanthus roseus reveals cascaded enzymatic activity in iridoid biosynthesis," *Sci Rep.* 5:8258 (6 pages).
Lee, et al. (2015) "A Highly Characterized Yeast Toolkit for Modular, Multipart Assembly" *ACS Synth. Biol* 4(9): 975-986.
Lichman, et al. (2018) "Uncoupled activation and cyclisation in catmint reductive terpenoid biosynthesis," Nature Chemical Biology 15: 71-79 (12 pages) *bioRxiv* doi: doi.org/10.1101/391953 (Posted Aug. 14, 2018).
Loeschcke, et al. (2012) "A Universal Tool for the Transfer and Expression of Biosynthetic Pathways in Bacteria" *ACS Synth. Biol* 2(1): 22-33.
Oswald, et al. (2007) "Monoterpenoid biosynthesis in *Saccharomyces cerevisiae*." *FEMS Yeast Res* 7(3): 413-21.
Polakowski, et al. (1998) "Overexpression of a cytosolic hydroxymethylglutaryl-CoA reductase leads to squalene accumulation in yeast." *Appl Microbiol Biotechnol* 49(1): 66-71.
Redding-Johanson, et al. (2011) "Targeted proteomics for metabolic pathway optimization: Application to terpene production" *Metabolic Engineering* 13(2): 194-203.
Reiling, et al. (2004) "Mono and diterpene production in *Escherichia coli*." *Biotechnol Bioeng* 87(2): 200-12.
Roth, et al. (2017) "Chemoenzymatic Synthesis of a Novel Borneol-Based Polyester." *ChemSusChem* 10(18): 3574-3580.
Sherden, et al. (2017) "Identification of iridoid synthases fromNepetaspecies: Iridoid cyclization does not determine nepetalactone stereochemistry" *Phytochemistry* 145: 48-56.
Smanski, et al. (2014) "Functional optimization of gene clusters by combinatorial design and assembly" *Nature Biotechnology* 32(12): 1241-1249.
Vasilev, et al. (2014) "Assessment of Cultivation Factors that Affect Biomass and Geraniol Production in Transgenic Tobacco Cell Suspension Cultures" *PLOS One* 9(8): e104620 (7 pages).
Vik, et al. (2001) "Upc2p and Ecm22p, dual regulators of sterol biosynthesis in *Saccharomyces cerevisiae*." *Mol Cell Biol* 21(19): 6395-405.
U.S. Appl. No. 16/450,780, filed Jun. 24, 2019, Tracewell, et al.
Billingsley, et al. (2017) "Engineering the biocatalytic selectivity of iridoid production in *Saccharomyces cerevisiae*." *Metabolic Engineering* 44: 117-125.
Billingsley, et al. (2019) "Production of semi-biosynthetic nepetalactone in yeast." *Journal of Industrial Microbiology & Biotechnology* 46: 1365-1370.
Jiang, et al. (2017) "Manipulation of GES and ERG20 for geraniol overproduction in *Saccharomyces cerevisiae*" *Metabolic Engineering* 41: 57-66.
Miettinen, et al. (2014) "The seco-iridoid pathway from Catharanthus roseus" *Nature Communications* 5: 3606 (12 pages).
Paddon, et al. (2013) "High-level semi-synthetic production of the potent antimalarial artemisinin" *Nature* 496: 528-532 (9 pages).
Zhao, et al. (2016) "Improving monoterpene geraniol production through geranyl diphosphate synthesis regulation in *Saccharomyces cerevisiae*" *Appl Microbiol Biotechnol* 100:4561-4571 (11 pages).
Zhao, et al. (2016) "Optimization of a Cytochrome P450 Oxidation System for Enhancing Protopanaxadiol Production in *Saccharomyces cerevisiae*" *Biotechnology and Bioengineering* 113(8): 1787-1795 (9 pages).
Zhao, et al. (2017) "Dynamic control of ERG20 expression combined with minimized endogenous downstream metabolism contributes to the improvement of geraniol production in *Saccharomyces cerevisiae*" *Microbial Cell Factories* 16:17 (11 pages).

| strain name | genotype |
|---|---|
| ScA01 | Δadh6: pGAL1-10:RsNEPS,Nc8HGO; pGAL7:NmISY; pGAL1-10:Cc8HGO,NcNOR; URA3 |
| ScA02 | Δoye2: pGAL1-10:RsNEPS,Nc8HGO; pGAL7:NmISY; pGAL1-10:Cc8HGO,NcNOR; URA3 |
| ScA03 | iho1: pGAL1-10:RsNEPS,Nc8HGO; pGAL7:NmISY; pGAL1-10:Cc8HGO, NcNOR; URA3 |
| ScB02 | iho1: pGAL1-10:RsNEPS,Nc8HGO; pGAL7:NmISY; pGAL1-10:Cc8HGO, NcNOR Δprb1: ADE1; pGAL7:NmG8H; pGAL1-10:CrCYB5,CrCPR;URA3 |
| ScB03 | iho1: pGAL1-10:RsNEPS,Nc8HGO; pGAL7:NmISY; pGAL1-10:Cc8HGO, NcNOR Δpep4: ADE1; pGAL7:NmG8H; pGAL1-10:CrCYB5,CrCPR;URA3 |
| ScC01 | iho1: pGAL1-10:RsNEPS,Nc8HGO; pGAL7:NmISY; pGAL1-10:Cc8HGO, NcNOR Δprb1: ADE1; pGAL7:NmG8H; pGAL1-10:CrCYB5,CrCPR Δho: pGAL1-10:ObGES,ScERG20(WW);URA3 |
| ScC02 | iho1: pGAL1-10:RsNEPS,Nc8HGO; pGAL7:NmISY; pGAL1-10:Cc8HGO, NcNOR Δprb1: ADE1; pGAL7:NmG8H; pGAL1-10:CrCYB5,CrCPR Δho: pGAL1-10:ObGES,ScERG20(WW); pGAL1:ScERG20(WW); URA3 |
| ScC03 | iho1: pGAL1-10:RsNEPS,Nc8HGO; pGAL7:NmISY; pGAL1-10:Cc8HGO, NcNOR Δprb1: ADE1; pGAL7:NmG8H; pGAL1-10:CrCYB5,CrCPR Δho: pGAL1-10:ObGES,ScERG20(WW); pGAL1-10:ScERG20(WW),ObGES; URA3 |

*FIG. 6B*

| gene name | source organism | SEQ ID NO. |
|---|---|---|
| ScERG20(WW) | Saccharomyces cerevisiae | 789 |
| ObGES | Ocimum basilicum | 930 |
| NmG8H | Nepeta mussinii | 1054 |
| CrCPR | Catharanthus roseus | 1075 |
| CrCYB5 | Catharanthus roseus | 1114 |
| Nc8HGO | Nepeta cataria | 1120 |
| Cc8HGO | Coffea canephora | 1128 |
| NmISY | Nepeta mussinii | 1163 |
| RsNEPS | Rauvolfia serpentina | 1511 |
| NcNOR | Nepeta cataria | 1393 |

FIG. 6C

NEPETALACTOL OXIDOREDUCTASES, NEPETALACTOL SYNTHASES, AND MICROBES CAPABLE OF PRODUCING NEPETALACTONE

CROSS-REFERENCE TO RELATED APPLICATIONS

This application is a continuation of PCT International application no. PCT/US2018/067333, filed on Dec. 21, 2018, which claims the benefit of U.S. provisional application No. 62/609,272, filed Dec. 21, 2017, U.S. provisional application No. 62/609,279, filed Dec. 21, 2017, and U.S. provisional application No. 62/669,919, filed May 10, 2018, all of which are hereby incorporated by reference in their entireties.

INCORPORATION BY REFERENCE OF THE SEQUENCE LISTING

The instant application contains a Sequence Listing which has been submitted electronically in ASCII format and is hereby incorporated by reference in its entirety. Said ASCII copy, created on Aug. 7, 2019, is named ZMGNP012C1US_SL.txt and is 5,630,616 bytes in size.

FIELD OF THE DISCLOSURE

The present disclosure relates generally to the area of production of nepetalactone. In particular, the disclosure relates to newly discovered genes encoding nepetalactol oxidoreductases (NORs), which catalyze the oxidation of nepetalactol to nepetalactone, and nepetalactol synthases (NEPSs), which catalyze the cyclization of 8-oxocitronellyl enolate into nepetalactol, where the enolate is the product resulting from the reduction of 8-oxogeranial, which is catalyzed by iridoid synthases (ISYs). The disclosure also relates to the heterologous expression of a biosynthetic pathway found in plants to produce microbes capable of synthesizing nepetalactone, as well as related compositions and methods.

BACKGROUND

Nepetalactone is an effective active ingredient for insect repellents. Current ingredients used for insect repellence such as N, N-Diethyl-meta-toluamide (DEET) pose health concerns, while other natural alternatives only offer short-term protection. Nepetalactone is derived primarily from the plant *Nepeta cataria*, but is produced at low levels. Yields are subject to environmental factors, such as climate and pests, creating an unreliable supply for broad use beyond acting as a cat attractant. Chemical synthesis is feasible, but not economical.

An approach to creating a more dependable supply of nepetalactone is to genetically engineer a microbial host for production of this chemical from glucose or to express one or more of the necessary enzymes, either in cell culture or in a cell-free protein expression system, which can be employed in a chemoenzymatic process for producing nepetalactone. A number of biochemical steps and the corresponding genetic elements have already been characterized to indirectly demonstrate the production of the nepetalactone precursor nepetalactol as an intermediate to a different natural product, strictosidine, in a microbial host. However, prior to the present work, the full pathway has not been recapitulated in any microorganism, and no efficient chemoenzymatic process for nepetalactone production from a precursor has been described.

SUMMARY

One approach to creating a more dependable supply of nepetalactone is to genetically engineer a microbial host for production of this chemical. A number of biochemical steps and the corresponding genetic elements have already been characterized to indirectly demonstrate the production of the nepetalactone precursor nepetalactol as an intermediate to a different natural product, strictosidine, in a microbial host. However, prior to the present work, the enzymes, nepetalactol oxidoreductase (NOR) and nepetalactol synthase (NEPS) remained uncharacterized, preventing complete biosynthesis of nepetalactone in any heterologous organism.

Various embodiments contemplated herein may include, but need not be limited to, one or more of the following:

Embodiment 1: An engineered cell, wherein the engineered cell expresses a non-native polypeptide, the non-native polypeptide having an activity selected from the group consisting of: a geraniol diphosphate synthase (GPPS); a geranyl diphosphate diphosphatase (geraniol synthase, GES); a geraniol 8-hydroxylase (G8H); a cytochrome P450 reductase (CPR) capable of promoting regeneration of the redox state of the G8H; a cytochrome B5 (CYB5) capable of promoting regeneration of the redox state of the G8H; an 8-hydroxygeraniol dehydrogenase (8HGO); an iridoid synthase (ISY); a nepetalactol oxidoreductase (NOR); cytochrome B5 reductase (CYBSR); and nepetalactol synthase (NEPS), or any combination thereof.

Embodiment 2: An engineered microbial cell, wherein the engineered microbial cell is capable of producing nepetalactone.

Embodiment 3: The engineered microbial cell of embodiments 1-2, wherein the engineered microbial cell expresses a non-native polypeptide having an activity selected from the group consisting of: a geraniol diphosphate synthase (GPPS); a geranyl diphosphate diphosphatase (geraniol synthase, GES); a geraniol 8-hydroxylase (G8H); a cytochrome P450 reductase (CPR) capable of promoting regeneration of the redox state of the G8H; a cytochrome B5 (CYB5) capable of promoting regeneration of the redox state of the G8H; an 8-hydroxygeraniol dehydrogenase (8HGO); an iridoid synthase (ISY); a nepetalactol oxidoreductase (NOR); cytochrome B5 reductase (CYBSR); and nepetalactol synthase (NEPS), or any combination thereof.

Embodiment 4: The engineered microbial cell of embodiments 1-3, wherein the engineered microbial cell expresses non-native polypeptide(s) having an activity comprising an 8-hydroxygeraniol dehydrogenase (8HGO); an iridoid synthase (ISY); a nepetalactol oxidoreductase (NOR), and a nepetalactol synthase (NEPS).

Embodiment 5: The engineered microbial cell of embodiments 1-4, wherein the engineered microbial cell expresses at least one, two, three, or more non-native enzymes selected from the group consisting of: a geraniol diphosphate synthase (GPPS); a geranyl diphosphate diphosphatase (geraniol synthase, GES); a geraniol 8-hydroxylase (G8H); a cytochrome P450 reductase (CPR) capable of promoting regeneration of the redox state of the G8H; a cytochrome B5 (CYB5) capable of promoting regeneration of the redox state of the G8H; an 8-hydroxygeraniol dehydrogenase (8HGO); an iridoid synthase (ISY); a nepetalactol oxidoreductase (NOR); cytochrome B5 reductase (CYBSR); and nepetalactol synthase (NEPS).

Embodiment 6: The engineered microbial cell of embodiments 1, wherein the engineered microbial cell expresses at least one non-native form of each of the enzymes of embodiment 1.

Embodiment 7: An engineered microbial cell, wherein the engineered microbial cell includes means for producing nepetalactone.

Embodiment 8: The engineered microbial cell of embodiment 1, wherein the engineered microbial cell includes means for expressing at least one, two, three, or more non-native enzymes selected from the group consisting of: a geraniol diphosphate synthase (GPPS); a geranyl diphosphate diphosphatase (geraniol synthase, GES); a geraniol 8-hydroxylase (G8H); a cytochrome P450 reductase (CPR) capable of promoting regeneration of the redox state of the G8H; a cytochrome B5 (CYB5) capable of promoting regeneration of the redox state of the G8H; an 8-hydroxygeraniol dehydrogenase (8HGO); an iridoid synthase (ISY); a nepetalactol oxidoreductase (NOR); and a nepetalactol oxidoreductase (NEPS).

Embodiment 9: The engineered microbial cell of embodiment 8, wherein the engineered microbial cell includes means for expressing at least one non-native form of each of the enzymes of embodiment 8.

Embodiment 10: The engineered microbial cell of any one of embodiments 1-9, wherein the microbial cell includes a fungal cell.

Embodiment 11: The engineered microbial cell of embodiment 10, wherein the microbial cell includes a yeast cell.

Embodiment 12: The engineered microbial cell of embodiment 11, wherein the yeast cell is a cell of the genus *Yarrowia*.

Embodiment 13: The engineered microbial cell of embodiment 12, wherein the yeast cell is a cell of the species *lipolytica*.

Embodiment 14: The engineered microbial cell of embodiment 11, wherein the yeast cell is a cell of the genus *Saccharomyces*.

Embodiment 15: The engineered microbial cell of embodiment 14, wherein the yeast cell is a cell of the species *cerevisiae*.

Embodiment 16: The engineered microbial cell of any one of embodiments 1-15, wherein, when cultured, the engineered microbial cell produces nepetalactone at a level greater than 10 μM of cell lysate or culture medium.

Embodiment 17: The engineered microbial cell of embodiment 16, wherein, when cultured, the engineered microbial cell produces nepetalactone at a level greater than 50 μM of cell lysate or culture medium.

Embodiment 18: An expression construct including a nucleotide sequence that encodes an active enzyme, wherein the active enzyme has an amino acid sequence that has at least 70% sequence identity with an amino acid sequence encoded by nucleotide sequence selected from the group consisting of: SEQ ID NOs:789-927, wherein the active enzyme is a geraniol diphosphate synthase (GPPS); SEQ ID NOs:928-1037, wherein the active enzyme is a geranyl diphosphate diphosphatase (geraniol synthase, GES); SEQ ID NOs:1038-1072, 1088-1110, wherein the active enzyme is a geraniol 8-hydroxylase (G8H); SEQ ID NOs:1073-1087, wherein the active enzyme is a cytochrome P450 reductase (CPR) capable of promoting regeneration of the redox state of the G8H; SEQ ID NOs:1111-1117, wherein the active enzyme is a cytochrome B5 (CYB5) capable of promoting regeneration of the redox state of the G8H; SEQ ID NOs:1118-1156, wherein the active enzyme is an 8-hydroxygeraniol dehydrogenase (8HGO); SEQ ID NOs:1157-1307, 1778-1807, wherein the active enzyme is an iridoid synthase (ISY); SEQ ID NOs:1308-1395, 1563-1570, 1725-1727, wherein the active enzyme is a nepetalactol oxidoreductase (NOR); SEQ ID NOs:1571-1576, wherein the active enzyme is a cytochrome B5 reductase (CYB5R); SEQ ID NOs:1506-1562, wherein the active enzyme is a nepetalactol synthase (NEPS); SEQ ID NOs:1396-1397, 1728-1777, wherein the active enzyme is a GPPS-GES fusion; SEQ ID NOs:1398-1462, wherein the active enzyme is a G8H-CPR fusion; SEQ ID NOs:1463-1481, wherein the active enzyme is a G8H-CPR-CYB5 fusion; SEQ ID NOs:1482-1493, wherein the active enzyme is a 8HGO-ISY fusion; or SEQ ID NOs:1494-1505, wherein the active enzyme is a ISY-NEPS fusion; wherein the enzyme-encoding nucleotide sequence is operably linked to a promoter sequence selected from the group consisting of SEQ ID NOs:1577-1633 or a terminator sequence selected from the group consisting of SEQ ID NOs:1634-1641.

Embodiment 19: An expression construct including a nucleotide sequence that encodes an active enzyme, wherein the nucleotide sequence has at least 60% sequence identity with a nucleotide sequence selected from the group consisting of: SEQ ID NOs:789-927, wherein the active enzyme is a geraniol diphosphate synthase (GPPS); SEQ ID NOs:928-1037, wherein the active enzyme is a geranyl diphosphate diphosphatase (geraniol synthase, GES); SEQ ID NOs:1038-1072, 1088-1110, wherein the active enzyme is a geraniol 8-hydroxylase (G8H); SEQ ID NOs:1073-1087, wherein the active enzyme is a cytochrome P450 reductase (CPR) capable of promoting regeneration of the redox state of the G8H; SEQ ID NOs:1111-1117, wherein the active enzyme is a cytochrome B5 (CYB5) capable of promoting regeneration of the redox state of the G8H; SEQ ID NOs:1118-1156, wherein the active enzyme is an 8-hydroxygeraniol dehydrogenase (8HGO); SEQ ID NOs:1157-1307, 1778-1807, wherein the active enzyme is an iridoid synthase (ISY); or SEQ ID NOs:1308-1395, 1563-1570, 1725-1727, wherein the active enzyme is a nepetalactol oxidoreductase (NOR); SEQ ID NOs:1571-1576, wherein the active enzyme is a cytochrome B5 reductase (CYB5R); SEQ ID NOs:1506-1562, wherein the active enzyme is a nepetalactol synthase (NEPS); SEQ ID NOs:1396-1397, 1728-1777, wherein the active enzyme is a GPPS-GES fusion; SEQ ID NOs:1398-1462, wherein the active enzyme is a G8H-CPR fusion; SEQ ID NOs:1463-1481, wherein the active enzyme is a G8H-CPR-CYB5 fusion; SEQ ID NOs:1482-1493, wherein the active enzyme is a 8HGO-ISY fusion; or SEQ ID NOs:1494-1505, wherein the active enzyme is a ISY-NEPS fusion; wherein the enzyme-encoding nucleotide sequence is operably linked to a promoter sequence selected from the group consisting of SEQ ID NOs:1577-1633 or a terminator sequence selected from the group consisting of SEQ ID NOs:1634-1641.

Embodiment 20: The expression construct of embodiment 18 or 19, wherein the enzyme-encoding nucleotide sequence is operably linked to the promoter sequence and the terminator sequence.

Embodiment 21: The expression construct of embodiment 18 or embodiment 19, wherein the enzyme-encoding nucleotide sequence has at least 60% sequence identity with a nucleotide sequence selected from the group consisting of SEQ ID NOs:789-927, wherein the active enzyme is a geraniol diphosphate synthase (GPPS).

Embodiment 22: The expression construct of embodiment 21, wherein the enzyme-encoding nucleotide sequence is a nucleotide sequence selected from the group consisting of SEQ ID NOs:789-927.

Embodiment 23: The expression construct of embodiment 18 or embodiment 19, wherein the enzyme-encoding nucleotide sequence has at least 60% sequence identity with a nucleotide sequence selected from the group consisting of SEQ ID NOs:928-1037, wherein the active enzyme is a geranyl diphosphate diphosphatase (geraniol synthase, GES).

Embodiment 24: The expression construct of embodiment 23, wherein the enzyme-encoding nucleotide sequence is a nucleotide sequence selected from the group consisting of SEQ ID NOs:928-1037.

Embodiment 25: The expression construct of embodiment 18 or embodiment 19, wherein the enzyme-encoding nucleotide sequence has at least 60% sequence identity with a nucleotide sequence selected from the group consisting of SEQ ID NOs: 1038-1072, 1088-1110, wherein the active enzyme is a geraniol 8-hydroxylase (G8H).

Embodiment 26: The expression construct of embodiment 25, wherein the enzyme-encoding nucleotide sequence is a nucleotide sequence selected from the group consisting of SEQ ID NOs:1038-1072, 1088-1110.

Embodiment 27: The expression construct of embodiment 18 or embodiment 19, wherein the enzyme-encoding nucleotide sequence has at least 60% sequence identity with a nucleotide sequence selected from the group consisting of SEQ ID NOs:1073-1087, wherein the active enzyme is a cytochrome P450 reductase (CPR) capable of promoting regeneration of the redox state of the G8H.

Embodiment 28: The expression construct of embodiment 27, wherein the enzyme-encoding nucleotide sequence is a nucleotide sequence selected from the group consisting of SEQ ID NOs:1073-1087.

Embodiment 29: The expression construct of embodiment 18 or embodiment 19, wherein the enzyme-encoding nucleotide sequence has at least 60% sequence identity with a nucleotide sequence selected from the group consisting of SEQ ID NOs:1111-1117, wherein the active enzyme is a cytochrome B5 (CYB5) capable of promoting regeneration of the redox state of the G8H.

Embodiment 30: The expression construct of embodiment 29, wherein the enzyme-encoding nucleotide sequence is a nucleotide sequence selected from the group consisting of SEQ ID NOs:1111-1117.

Embodiment 31: The expression construct of embodiment 18 or embodiment 19, wherein the enzyme-encoding nucleotide sequence has at least 60% sequence identity with a nucleotide sequence selected from the group consisting of SEQ ID NOs:1118-1156, wherein the active enzyme is an 8-hydroxygeraniol dehydrogenase (8HGO).

Embodiment 32: The expression construct of embodiment 31, wherein the enzyme-encoding nucleotide sequence is a nucleotide sequence selected from the group consisting of SEQ ID NOs:1118-1156.

Embodiment 33: The expression construct of embodiment 18 or embodiment 19, wherein the enzyme-encoding nucleotide sequence has at least 60% sequence identity with a nucleotide sequence selected from the group consisting of SEQ ID NOs:1157-1307, 1778-1807, wherein the active enzyme is an iridoid synthase (ISY).

Embodiment 34: The expression construct of embodiment 33, wherein the iridoid synthase (ISY) has been modified to improve substrate specificity.

Embodiment 35: The expression construct of embodiment 34, wherein the enzyme-encoding nucleotide sequence is a nucleotide sequence selected from the group consisting of SEQ ID NOs:1157-1307, 1778-1807.

Embodiment 36: The expression construct of embodiment 18 or embodiment 19, wherein the enzyme-encoding nucleotide sequence has at least 60% sequence identity with a nucleotide sequence selected from the group consisting of SEQ ID NOs:1308-1395, 1563-1570, 1725-1727, wherein the active enzyme is a nepetalactol oxidoreductase (NOR).

Embodiment 37: The expression construct of embodiment 36, wherein the enzyme-encoding nucleotide sequence is a nucleotide sequence selected from the group consisting of SEQ ID NOs:1308-1395, 1563-1570, 1725-1727.

Embodiment 38: The expression construct of embodiment 18 or embodiment 19, wherein the selected nucleotide sequence is (SEQ ID NO:1120).

Embodiment 39: The expression construct of embodiment 18 or embodiment 19, wherein the selected nucleotide sequence is (SEQ ID NO:1121).

Embodiment 40: The expression construct of embodiment 18 or embodiment 19, wherein the selected nucleotide sequence is (SEQ ID NO:1122).

Embodiment 41: The expression construct of embodiment 18 or embodiment 19, wherein the selected nucleotide sequence is (SEQ ID NO:1123).

Embodiment 42: The expression construct of embodiment 18 or embodiment 19, wherein the selected nucleotide sequence is (SEQ ID NO:1124).

Embodiment 43: The expression construct of embodiment 18 or embodiment 19, wherein the selected nucleotide sequence is (SEQ ID NO:1125).

Embodiment 44: The expression construct of embodiment 18 or embodiment 19, wherein the selected nucleotide sequence is (SEQ ID NO:1126).

Embodiment 45: The expression construct of embodiment 18 or embodiment 19, wherein the selected nucleotide sequence is (SEQ ID NO:1127).

Embodiment 46: The expression construct of embodiment 18 or embodiment 19, wherein the selected nucleotide sequence is (SEQ ID NO:1128).

Embodiment 47: The expression construct of embodiment 18 or embodiment 19, wherein the selected nucleotide sequence is (SEQ ID NO:1129).

Embodiment 48: The expression construct of embodiment 18 or embodiment 19, wherein the selected nucleotide sequence is (SEQ ID NO:1130).

Embodiment 49: The expression construct of embodiment 18 or embodiment 19, wherein the selected nucleotide sequence is (SEQ ID NO:1131).

Embodiment 50: The expression construct of embodiment 18 or embodiment 19, wherein the selected nucleotide sequence is (SEQ ID NO:1075).

Embodiment 51: The expression construct of embodiment 18 or embodiment 19, wherein the selected nucleotide sequence is (SEQ ID NO:1077).

Embodiment 52: The expression construct of embodiment 18 or embodiment 19, wherein the selected nucleotide sequence is (SEQ ID NO:1041).

Embodiment 53: The expression construct of embodiment 18 or embodiment 19, wherein the selected nucleotide sequence is (SEQ ID NO:1054).

Embodiment 54: The expression construct of embodiment 18 or embodiment 19, wherein the selected nucleotide sequence is (SEQ ID NO:1056).

Embodiment 55: The expression construct of embodiment 18 or embodiment 19, wherein the selected nucleotide sequence is (SEQ ID NO:1063).

Embodiment 56: The expression construct of embodiment 18 or embodiment 19, wherein the selected nucleotide sequence is (SEQ ID NO:1067).

Embodiment 57: The expression construct of embodiment 18 or embodiment 19, wherein the selected nucleotide sequence is (SEQ ID NO:1417).

Embodiment 58: The expression construct of embodiment 18 or embodiment 19, wherein the selected nucleotide sequence is (SEQ ID NO:930).

Embodiment 59: The expression construct of embodiment 18 or embodiment 19, wherein the selected nucleotide sequence is (SEQ ID NO:931).

Embodiment 60: The expression construct of embodiment 18 or embodiment 19, wherein the selected nucleotide sequence is (SEQ ID NO:932).

Embodiment 61: The expression construct of embodiment 18 or embodiment 19, wherein the selected nucleotide sequence is (SEQ ID NO:934).

Embodiment 62: The expression construct of embodiment 18 or embodiment 19, wherein the selected nucleotide sequence is (SEQ ID NO:937).

Embodiment 63: The expression construct of embodiment 18 or embodiment 19, wherein the selected nucleotide sequence is (SEQ ID NO:938).

Embodiment 64: The expression construct of embodiment 18 or embodiment 19, wherein the selected nucleotide sequence is (SEQ ID NO:1396).

Embodiment 65: The expression construct of embodiment 18 or embodiment 19, wherein the selected nucleotide sequence is (SEQ ID NO:791).

Embodiment 66: The expression construct of embodiment 18 or embodiment 19, wherein the selected nucleotide sequence is (SEQ ID NO:793).

Embodiment 67: The expression construct of embodiment 18 or embodiment 19, wherein the selected nucleotide sequence is (SEQ ID NO:897).

Embodiment 68: The expression construct of embodiment 18 or embodiment 19, wherein the selected nucleotide sequence is (SEQ ID NO:898).

Embodiment 69: The expression construct of embodiment 18 or embodiment 19, wherein the selected nucleotide sequence is (SEQ ID NO:900).

Embodiment 70: The expression construct of embodiment 18 or embodiment 19, wherein the selected nucleotide sequence is (SEQ ID NO:901).

Embodiment 71: The expression construct of embodiment 18 or embodiment 19, wherein the selected nucleotide sequence is (SEQ ID NO:914).

Embodiment 72: The expression construct of embodiment 18 or embodiment 19, wherein the selected nucleotide sequence is (SEQ ID NO:915).

Embodiment 73: The expression construct of embodiment 18 or embodiment 19, wherein the selected nucleotide sequence is (SEQ ID NO:916).

Embodiment 74: The expression construct of embodiment 18 or embodiment 19, wherein the selected nucleotide sequence is (SEQ ID NO:917).

Embodiment 75: The expression construct of embodiment 18 or embodiment 19, wherein the selected nucleotide sequence is (SEQ ID NO:918).

Embodiment 76: The expression construct of embodiment 18 or embodiment 19, wherein the selected nucleotide sequence is (SEQ ID NO:919).

Embodiment 77: The expression construct of embodiment 18 or embodiment 19, wherein the selected nucleotide sequence is (SEQ ID NO:1163).

Embodiment 78: The expression construct of embodiment 18 or embodiment 19, wherein the selected nucleotide sequence is (SEQ ID NO:1169).

Embodiment 79: The expression construct of embodiment 18 or embodiment 19, wherein the selected nucleotide sequence is (SEQ ID NO:1170).

Embodiment 80: The expression construct of embodiment 18 or embodiment 19, wherein the selected nucleotide sequence is (SEQ ID NO:1171).

Embodiment 81: The expression construct of embodiment 18 or embodiment 19, wherein the selected nucleotide sequence is (SEQ ID NO:1172).

Embodiment 82: The expression construct of embodiment 18 or embodiment 19, wherein the selected nucleotide sequence is (SEQ ID NO:1173).

Embodiment 83: The expression construct of embodiment 18 or embodiment 19, wherein the selected nucleotide sequence is (SEQ ID NO:1174).

Embodiment 84: The expression construct of embodiment 18 or embodiment 19, wherein the selected nucleotide sequence is (SEQ ID NO:1175).

Embodiment 85: The expression construct of embodiment 18 or embodiment 19, wherein the selected nucleotide sequence is (SEQ ID NO:1176).

Embodiment 86: The expression construct of embodiment 18 or embodiment 19, wherein the selected nucleotide sequence is (SEQ ID NO:1177).

Embodiment 87: The expression construct of embodiment 18 or embodiment 19, wherein the selected nucleotide sequence is (SEQ ID NO:1506).

Embodiment 88: The expression construct of embodiment 18 or embodiment 19, wherein the selected nucleotide sequence is (SEQ ID NO:1507).

Embodiment 89: The expression construct of embodiment 18 or embodiment 19, wherein the selected nucleotide sequence is (SEQ ID NO:1508).

Embodiment 90: The expression construct of embodiment 18 or embodiment 19, wherein the selected nucleotide sequence is (SEQ ID NO:1509).

Embodiment 91: The expression construct of embodiment 18 or embodiment 19, wherein the selected nucleotide sequence is (SEQ ID NO:1510).

Embodiment 92: The expression construct of embodiment 18 or embodiment 19, wherein the selected nucleotide sequence is (SEQ ID NO:1511).

Embodiment 93: The expression construct of embodiment 18 or embodiment 19, wherein the selected nucleotide sequence is (SEQ ID NO:1512).

Embodiment 94: The expression construct of embodiment 18 or embodiment 19, wherein the selected nucleotide sequence is (SEQ ID NO:1513).

Embodiment 95: The expression construct of embodiment 18 or embodiment 19, wherein the selected nucleotide sequence is (SEQ ID NO:1514).

Embodiment 96: The expression construct of embodiment 18 or embodiment 19, wherein the selected nucleotide sequence is (SEQ ID NO:1515).

Embodiment 97: The expression construct of embodiment 18 or embodiment 19, wherein the selected nucleotide sequence is (SEQ ID NO:1516).

Embodiment 98: The expression construct of embodiment 18 or embodiment 19, wherein the selected nucleotide sequence is (SEQ ID NO:1517).

Embodiment 99: The expression construct of embodiment 18 or embodiment 19, wherein the selected nucleotide sequence is (SEQ ID NO:1518).

Embodiment 100: The expression construct of embodiment 18 or embodiment 19, wherein the selected nucleotide sequence is (SEQ ID NO:1519).

Embodiment 101: The expression construct of embodiment 18 or embodiment 19, wherein the selected nucleotide sequence is (SEQ ID NO:1520).

Embodiment 102: The expression construct of embodiment 18 or embodiment 19, wherein the selected nucleotide sequence is (SEQ ID NO:1521).

Embodiment 103: The expression construct of embodiment 18 or embodiment 19, wherein the selected nucleotide sequence is (SEQ ID NO:1114).

Embodiment 104: The expression construct of embodiment 18 or embodiment 19, wherein the selected nucleotide sequence is (SEQ ID NO:1115).

Embodiment 105: The expression construct of embodiment 18 or embodiment 19, wherein the selected nucleotide sequence is (SEQ ID NO:1086).

Embodiment 106: The expression construct of embodiment 18 or embodiment 19, wherein the selected nucleotide sequence is (SEQ ID NO:1308).

Embodiment 107: The expression construct of embodiment 18 or embodiment 19, wherein the selected nucleotide sequence is (SEQ ID NO:1309).

Embodiment 108: The expression construct of embodiment 18 or embodiment 19, wherein the selected nucleotide sequence is (SEQ ID NO:1393).

Embodiment 109: The expression construct of any one of embodiments 18-108, wherein the selected nucleotide sequence is operably linked to a promoter sequence including (SEQ ID NO:1577).

Embodiment 110: The expression construct of any one of embodiments 18-108, wherein the selected nucleotide sequence is operably linked to a promoter sequence including (SEQ ID NO:1578).

Embodiment 111: The expression construct of any one of embodiments 18-108, wherein the selected nucleotide sequence is operably linked to a promoter sequence including (SEQ ID NO:1579).

Embodiment 112: The expression construct of any one of embodiments 18-108, wherein the selected nucleotide sequence is operably linked to a promoter sequence including (SEQ ID NO:1580).

Embodiment 113: The expression construct of any one of embodiments 18-108, wherein the selected nucleotide sequence is operably linked to a promoter sequence including (SEQ ID NO:1581).

Embodiment 114: The expression construct of any one of embodiments 18-108, wherein the selected nucleotide sequence is operably linked to a promoter sequence including (SEQ ID NO:1582).

Embodiment 115: The expression construct of any one of embodiments 18-108, wherein the selected nucleotide sequence is operably linked to a promoter sequence including (SEQ ID NO:1583).

Embodiment 116: The expression construct of any one of embodiments 18-108, wherein the selected nucleotide sequence is operably linked to a promoter sequence including (SEQ ID NO:1584).

Embodiment 117: The expression construct of any one of embodiments 18-108, wherein the selected nucleotide sequence is operably linked to a promoter sequence including (SEQ ID NO:1585).

Embodiment 118: The expression construct of any one of embodiments 18-108, wherein the selected nucleotide sequence is operably linked to a promoter sequence including (SEQ ID NO:1586).

Embodiment 119: The expression construct of any one of embodiments 18-108, wherein the selected nucleotide sequence is operably linked to a promoter sequence including (SEQ ID NO:1587).

Embodiment 120: The expression construct of any one of embodiments 18-108, wherein the selected nucleotide sequence is operably linked to a promoter sequence including (SEQ ID NO:1588).

Embodiment 121: The expression construct of any one of embodiments 18-108, wherein the selected nucleotide sequence is operably linked to a promoter sequence including (SEQ ID NO:1589).

Embodiment 122: The expression construct of any one of embodiments 18-108, wherein the selected nucleotide sequence is operably linked to a promoter sequence including (SEQ ID NO:1590).

Embodiment 123: The expression construct of any one of embodiments 18-108, wherein the selected nucleotide sequence is operably linked to a promoter sequence including (SEQ ID NO:1591).

Embodiment 124: The expression construct of any one of embodiments 18-108, wherein the selected nucleotide sequence is operably linked to a promoter sequence including (SEQ ID NO:1592).

Embodiment 125: The expression construct of any one of embodiments 18-108, wherein the selected nucleotide sequence is operably linked to a promoter sequence including (SEQ ID NO:1593).

Embodiment 126: The expression construct of any one of embodiments 18-108, wherein the selected nucleotide sequence is operably linked to a promoter sequence including (SEQ ID NO:1594).

Embodiment 127: The expression construct of any one of embodiments 18-108, wherein the selected nucleotide sequence is operably linked to a promoter sequence including (SEQ ID NO:1595).

Embodiment 128: The expression construct of any one of embodiments 18-108, wherein the selected nucleotide sequence is operably linked to a promoter sequence including (SEQ ID NO:1596).

Embodiment 129: The expression construct of any one of embodiments 18-108, wherein the selected nucleotide sequence is operably linked to a promoter sequence including (SEQ ID NO:1597).

Embodiment 130: The expression construct of any one of embodiments 18-108, wherein the selected nucleotide sequence is operably linked to a promoter sequence including (SEQ ID NO:1598).

Embodiment 131: The expression construct of any one of embodiments 18-108, wherein the selected nucleotide sequence is operably linked to a promoter sequence including (SEQ ID NO:1599).

Embodiment 132: The expression construct of any one of embodiments 18-108, wherein the selected nucleotide sequence is operably linked to a promoter sequence including (SEQ ID NO:1600).

Embodiment 133: The expression construct of any one of embodiments 18-108, wherein the selected nucleotide sequence is operably linked to a promoter sequence including (SEQ ID NO:1601).

Embodiment 134: The expression construct of any one of embodiments 18-108, wherein the selected nucleotide sequence is operably linked to a promoter sequence including (SEQ ID NO:1602).

Embodiment 135: The expression construct of any one of embodiments 18-108, wherein the selected nucleotide sequence is operably linked to a promoter sequence including (SEQ ID NO:1603).

Embodiment 136: The expression construct of any one of embodiments 18-108, wherein the selected nucleotide sequence is operably linked to a promoter sequence including (SEQ ID NO:1604).

Embodiment 137: The expression construct of any one of embodiments 18-108, wherein the selected nucleotide sequence is operably linked to a promoter sequence including (SEQ ID NO:1605).

Embodiment 138: The expression construct of any one of embodiments 18-108, wherein the selected nucleotide sequence is operably linked to a promoter sequence including (SEQ ID NO:1606).

Embodiment 139: The expression construct of any one of embodiments 18-108, wherein the selected nucleotide sequence is operably linked to a promoter sequence including (SEQ ID NO:1607).

Embodiment 140: The expression construct of any one of embodiments 18-108, wherein the selected nucleotide sequence is operably linked to a promoter sequence including (SEQ ID NO:1608).

Embodiment 141: The expression construct of any one of embodiments 18-108, wherein the selected nucleotide sequence is operably linked to a promoter sequence including (SEQ ID NO:1609).

Embodiment 142: The expression construct of any one of embodiments 18-108, wherein the selected nucleotide sequence is operably linked to a promoter sequence including (SEQ ID NO:1610).

Embodiment 143: The expression construct of any one of embodiments 18-108, wherein the selected nucleotide sequence is operably linked to a promoter sequence including (SEQ ID NO:1611).

Embodiment 144: The expression construct of any one of embodiments 18-108, wherein the selected nucleotide sequence is operably linked to a promoter sequence including (SEQ ID NO:1612).

Embodiment 145: The expression construct of any one of embodiments 18-108, wherein the selected nucleotide sequence is operably linked to a promoter sequence including (SEQ ID NO:1613).

Embodiment 146: The expression construct of any one of embodiments 18-108, wherein the selected nucleotide sequence is operably linked to a promoter sequence including (SEQ ID NO:1614).

Embodiment 147: The expression construct of any one of embodiments 18-108, wherein the selected nucleotide sequence is operably linked to a promoter sequence including (SEQ ID NO:1615).

Embodiment 148: The expression construct of any one of embodiments 18-108, wherein the selected nucleotide sequence is operably linked to a promoter sequence including (SEQ ID NO:1616).

Embodiment 149: The expression construct of any one of embodiments 18-108, wherein the selected nucleotide sequence is operably linked to a promoter sequence including (SEQ ID NO:1617).

Embodiment 150: The expression construct of any one of embodiments 18-108, wherein the selected nucleotide sequence is operably linked to a promoter sequence including (SEQ ID NO:1618).

Embodiment 151: The expression construct of any one of embodiments 18-108, wherein the selected nucleotide sequence is operably linked to a promoter sequence including (SEQ ID NO:1619).

Embodiment 152: The expression construct of any one of embodiments 18-108, wherein the selected nucleotide sequence is operably linked to a promoter sequence including (SEQ ID NO:1620).

Embodiment 153: The expression construct of any one of embodiments 18-108, wherein the selected nucleotide sequence is operably linked to a promoter sequence including (SEQ ID NO:1621).

Embodiment 154: The expression construct of any one of embodiments 18-108, wherein the selected nucleotide sequence is operably linked to a promoter sequence including (SEQ ID NO:1622).

Embodiment 155: The expression construct of any one of embodiments 18-108, wherein the selected nucleotide sequence is operably linked to a promoter sequence including (SEQ ID NO:1623).

Embodiment 156: The expression construct of any one of embodiments 18-108, wherein the selected nucleotide sequence is operably linked to a promoter sequence including (SEQ ID NO:1624).

Embodiment 157: The expression construct of any one of embodiments 18-108, wherein the selected nucleotide sequence is operably linked to a promoter sequence including (SEQ ID NO:1625).

Embodiment 158: The expression construct of any one of embodiments 18-108, wherein the selected nucleotide sequence is operably linked to a promoter sequence including (SEQ ID NO:1626).

Embodiment 159: The expression construct of any one of embodiments 18-108, wherein the selected nucleotide sequence is operably linked to a promoter sequence including (SEQ ID NO:1627).

Embodiment 160: The expression construct of any one of embodiments 18-108, wherein the selected nucleotide sequence is operably linked to a promoter sequence including (SEQ ID NO:1628).

Embodiment 161: The expression construct of any one of embodiments 18-108, wherein the selected nucleotide sequence is operably linked to a promoter sequence including (SEQ ID NO:1629).

Embodiment 162: The expression construct of any one of embodiments 18-108, wherein the selected nucleotide sequence is operably linked to a promoter sequence including (SEQ ID NO:1630).

Embodiment 163: The expression construct of any one of embodiments 18-108, wherein the selected nucleotide sequence is operably linked to a promoter sequence including (SEQ ID NO:1631).

Embodiment 164: The expression construct of any one of embodiments 18-108, wherein the selected nucleotide sequence is operably linked to a promoter sequence including (SEQ ID NO:1632).

Embodiment 165: The expression construct of any one of embodiments 18-108, wherein the selected nucleotide sequence is operably linked to a promoter sequence including (SEQ ID NO:1633).

Embodiment 166: The expression construct of any one of embodiments 18-165, wherein the enzyme-encoding nucleotide sequence is operably linked to a terminator sequence including (SEQ ID NO:1634).

Embodiment 167: The expression construct of any one of embodiments 18-165, wherein the enzyme-encoding nucleotide sequence is operably linked to a terminator sequence including (SEQ ID NO:1635).

Embodiment 168: The expression construct of any one of embodiments 18-165, wherein the enzyme-encoding nucleotide sequence is operably linked to a terminator sequence including (SEQ ID NO:1636).

Embodiment 169: The expression construct of any one of embodiments 18-165, wherein the enzyme-encoding nucleotide sequence is operably linked to a terminator sequence including (SEQ ID NO:1637).

Embodiment 170: The expression construct of any one of embodiments 18-165, wherein the enzyme-encoding nucleotide sequence is operably linked to a terminator sequence including (SEQ ID NO:1638).

Embodiment 171: The expression construct of any one of embodiments 18-165, wherein the enzyme-encoding nucleotide sequence is operably linked to a terminator sequence including (SEQ ID NO:1639).

Embodiment 172: The expression construct of any one of embodiments 18-165, wherein the enzyme-encoding nucleotide sequence is operably linked to a terminator sequence including (SEQ ID NO:1640).

Embodiment 173: The expression construct of any one of embodiments 18-165, wherein the enzyme-encoding nucleotide sequence is operably linked to a terminator sequence including (SEQ ID NO:1641).

Embodiment 174: A centromeric or episomal plasmid including the expression construct of any one of embodiments 18-173.

Embodiment 175: An engineered microbial cell including the expression construct of any one of embodiments 18-173.

Embodiment 176: The engineered microbial cell of embodiment 175, wherein the engineered microbial cell is capable of producing nepetalactone.

Embodiment 177: The engineered microbial cell of embodiment 176, wherein the engineered microbial cell includes a yeast cell.

Embodiment 178: The engineered microbial cell of embodiment 177, wherein the yeast cell is a cell of the genus *Yarrowia*.

Embodiment 179: The engineered microbial cell of embodiment 178, wherein the yeast cell is a cell of the species *lipolytica*.

Embodiment 180: The engineered microbial cell of embodiment 177, wherein the yeast cell is a cell of the genus *Saccharomyces*.

Embodiment 181: The engineered microbial cell of embodiment 180, wherein the yeast cell is a cell of the species *cerevisiae*.

Embodiment 182: The engineered microbial cell of any one of embodiments 176-181, wherein, when cultured, the engineered microbial cell produces nepetalactone at a level greater than 10 µM of cell lysate or culture medium.

Embodiment 183: The engineered microbial cell of embodiment 176-181, wherein, when cultured, the engineered microbial cell produces nepetalactone at a level greater than 50 µM of cell lysate or culture medium.

Embodiment 184: A culture of engineered microbial cells according to any one of embodiments 1-17 or 175-183.

Embodiment 185: The culture of embodiment 184, wherein the substrate includes a carbon source and a nitrogen source selected from the group consisting of urea, an ammonium salt, ammonia, and any combination thereof.

Embodiment 186: The culture of embodiment 184, wherein the substrate includes a carbon source selected from the group consisting of geraniol and 8-hydroxygeraniol, and any combination thereof.

Embodiment 187: The culture of any one of embodiments 184-186, wherein the engineered microbial cells are present in a concentration such that the culture has an optical density at 600 nm of 1-500, optionally wherein the optical density is measured without concentrating cells.

Embodiment 188: The culture of any one of embodiments 184-187, wherein the culture includes nepetalactone.

Embodiment 189: The culture of any one of embodiments 184-188, wherein the culture includes nepetalactone at a level greater than 10 µM of cell lysate or culture medium.

Embodiment 190: The culture of any one of embodiments 184-188, wherein the culture includes nepetalactone at a level greater than 50 µM of cell lysate or culture medium.

Embodiment 191: A method of culturing engineered microbial cells according to any one of embodiments 1-17 or 175-183, the method including culturing the engineered microbial cells under suitable conditions, wherein the engineered microbial cells produce nepetalactone.

Embodiment 192: The method of embodiment 191, wherein the method includes culturing the cells in the presence of a fermentation substrate including a non-protein carbon and a non-protein nitrogen source.

Embodiment 193: The method of embodiment 191, wherein the method includes culturing the cells in the presence of a fermentation substrate including geraniol and/or 8-hydroxygeraniol.

Embodiment 194: The method of embodiment 191, wherein the method includes fed-batch culture, with an initial glucose level in the range of 1-100 g/L, followed by controlled sugar feeding.

Embodiment 195: The method of embodiment 191, wherein the method includes fed-batch culture, with an initial geraniol level in the range of 0.1-100 g/L.

Embodiment 196: The method of embodiment 191, wherein the method includes fed-batch culture, with an initial 8-hydroxygeraniol level in the range of 0.1-100 g/L.

Embodiment 197: The method of embodiment 191 or embodiment 194, wherein the fermentation substrate includes glucose and a nitrogen source selected from the group consisting of urea, an ammonium salt, ammonia, and any combination thereof.

Embodiment 198: The method of any one of embodiments 191-197, wherein the culture is pH-controlled during culturing.

Embodiment 199: The method of any one of embodiments 191-198, wherein the culture is aerated during culturing.

Embodiment 200: The method of any one of embodiments 191-199, wherein the engineered microbial cells produce nepetalactone at a level greater than 10 µM of cell lysate or culture medium.

Embodiment 201: The method of embodiment 200, wherein the engineered microbial cells produce nepetalactone at a level greater than 50 µM of cell lysate or culture medium.

Embodiment 202: The method of any one of embodiments 191-201, wherein the method additionally includes recovering nepetalactone from the culture.

Embodiment 203: The method of embodiment 202, wherein the method additionally includes converting nepetalactone to dihydronepetalactone.

Embodiment 204: The method of embodiment 203, wherein nepetalactone is converted to dihydronepetalactone by contacting nepetalactone with hydrogen and a hydrogenation catalyst.

Embodiment 205: An engineered non-plant cell, wherein the engineered non-plant cell expresses one or more non-native enzyme selected from the group consisting of: a geraniol diphosphate synthase (GPPS); a geranyl diphosphate diphosphatase (geraniol synthase, GES); a geraniol 8-hydroxylase (G8H); a cytochrome P450 reductase (CPR) capable of promoting regeneration of the redox state of the G8H; a cytochrome B5 (CYB5) capable of promoting regeneration of the redox state of the G8H; an 8-hydroxygeraniol dehydrogenase (8HGO); an iridoid synthase (ISY); a nepetalactol oxidoreductase (NOR); cytochrome B5 reductase (CYBSR); and nepetalactol synthase (NEPS), or any combination thereof.

Embodiment 206: An engineered non-plant cell, wherein the engineered non-plant cell expresses a non-native nepetalactol oxidoreductase (NOR).

Embodiment 207: An engineered non-plant cell, wherein the engineered non-plant cell includes means for expressing a non-native enzyme selected from the group consisting of: a geraniol diphosphate synthase (GPPS); a geranyl diphosphate diphosphatase (geraniol synthase, GES); a geraniol 8-hydroxylase (G8H); a cytochrome P450 reductase (CPR) capable of promoting regeneration of the redox state of the G8H; a cytochrome B5 (CYB5) capable of promoting regeneration of the redox state of the G8H; an 8-hydroxygeraniol dehydrogenase (8HGO); an iridoid synthase (ISY); a nepetalactol oxidoreductase (NOR); cytochrome B5 reductase (CYB5R); and nepetalactol synthase (NEPS), or any combination thereof.

Embodiment 208: An engineered non-plant cell, wherein the engineered non-plant cell includes means for expressing a non-native nepetalactol oxidoreductase (NOR).

Embodiment 209: The engineered non-plant cell of embodiments 205-208, wherein the engineered non-plant cell is capable of producing nepetalactol.

Embodiment 210: The engineered non-plant cell of embodiments 205-209, wherein the engineered non-plant cell has been engineered to produce nepetalactol.

Embodiment 211: The engineered non-plant cell of embodiment 208, wherein the engineered non-plant cell further expresses: a non-native geranyl diphosphate diphosphatase (geraniol synthase (GES)); geraniol 8-hydroxylase; 8-hydroxygeraniol dehydrogenase; and iridoid synthase (ISY).

Embodiment 212: The engineered non-plant cell of any one of embodiments 205-211, wherein the engineered non-plant cell includes a microbial cell.

Embodiment 213: The engineered non-plant cell of embodiment 212, wherein the microbial cell includes a bacterial cell.

Embodiment 214: The engineered non-plant cell of embodiment 213, wherein the bacterial cell is a cell of the genus *Escherichia* or *Corynebacterium*.

Embodiment 215: The engineered non-plant cell of embodiment 214, wherein the bacterial cell is a cell of the species *E. coli* or *C. glutamicum*.

Embodiment 216: The engineered non-plant cell of embodiment 212, wherein the microbial cell includes a fungal cell.

Embodiment 217: The engineered non-plant cell of embodiment 216, wherein the microbial cell includes a yeast cell.

Embodiment 218: The engineered non-plant cell of embodiment 217, wherein the bacterial cell is a cell of the genus *Saccharomyces* or *Yarrowia*.

Embodiment 219: The engineered non-plant cell of embodiment 218, wherein the bacterial cell is a cell of the species *S. cerevisiae* or *Y. lipolytica*.

Embodiment 220: The engineered non-plant cell of any one of embodiments 205-219, wherein, when cultured, the engineered non-plant cell produces sufficient nepetalactol oxidoreductase (NOR) to convert nepetalactol to nepetalactone at a level greater than 10 µM of cell lysate or culture medium.

Embodiment 221: The engineered non-plant cell of embodiment 220, wherein, when cultured, the engineered non-plant cell produces sufficient nepetalactol oxidoreductase (NOR) to convert nepetalactol to nepetalactone at a level greater than 50 µM of cell lysate or culture medium.

Embodiment 222: A culture of engineered non-plant cells according to any one of embodiments 205-221.

Embodiment 223: The culture of embodiment 222, wherein the engineered non-plant cells are present in a concentration such that the culture has an optical density at 600 nm of 1-500, optionally wherein the optical density is measured without concentrating cells.

Embodiment 224: The culture of any one of embodiments 222-223, wherein the culture includes nepetalactone.

Embodiment 225: The culture of any one of embodiments 222-224, wherein the culture includes nepetalactone at a level greater than 10 µM of culture medium.

Embodiment 226: The culture of embodiment 225, wherein the culture includes nepetalactone at a level greater than 50 µM of culture medium.

Embodiment 227: A method of culturing engineered non-plant cells according to any one of embodiments 205-221, the method including culturing the cells under suitable conditions, whereby the engineered non-plant cells express the non-native nepetalactol oxidoreductase (NOR).

Embodiment 228: A method of culturing engineered non-plant cells according to any one of embodiments 205-221, the method including culturing the cells under suitable conditions, whereby the engineered non-plant cells produce nepetalactone.

Embodiment 229: The method of embodiments 227-228, wherein the method includes fed-batch culture, with an initial glucose level in the range of 1-100 g/L, followed by controlled sugar feeding.

Embodiment 230: The method of embodiment 229, wherein the method includes fed-batch culture, with an initial geraniol level in the range of 0.1-100 g/L.

Embodiment 231: The method of embodiment 229, wherein the method includes fed-batch culture, with an initial 8-hydroxygeraniol level in the range of 0.1-100 g/L.

Embodiment 232: The method of embodiments 227-228, wherein the fermentation substrate includes glucose and a nitrogen source selected from the group consisting of urea, an ammonium salt, ammonia, and any combination thereof.

Embodiment 233: The method of any one of embodiments 227-232, wherein the culture is pH-controlled during culturing.

Embodiment 234: The method of any one of embodiments 227-233, wherein the culture is aerated during culturing.

Embodiment 235: The method of any one of embodiments 227-234, wherein the engineered non-plant cells produce sufficient nepetalactol oxidoreductase (NOR) to convert nepetalactol to nepetalactone at a level greater than 10 µM of cell lysate or culture medium.

Embodiment 236: The method of embodiment 235, wherein the engineered non-plant cells produce sufficient nepetalactol oxidoreductase (NOR) to convert nepetalactol to nepetalactone at a level greater than 50 µM of cell lysate or culture medium.

Embodiment 237: The method of any one of embodiments 227-236, wherein the method additionally includes recovering nepetalactone from the culture.

Embodiment 238: A polynucleotide including a nucleotide sequence that encodes an active nepetalactol oxidoreductase (NOR) including an amino acid sequence that has: at least 70% sequence identity with any one of SEQ ID NOs:520-607, 775-782, 1642-1644.

Embodiment 239: A polynucleotide including a nucleotide sequence that encodes an active nepetalactol oxidoreductase (NOR) including an amino acid sequence that has: more than 90% sequence identity with any one of SEQ ID NOs:520-607, 775-782, 1642-1644.

Embodiment 240: The polynucleotide of any one of embodiments 238-239, wherein the encoded nepetalactol oxidoreductase (NOR) has at least 95% sequence identity with one of SEQ ID NOs:520-607, 775-782, 1642-1644.

Embodiment 241: The polynucleotide of any one of embodiments 238-239, wherein the polynucleotide includes a nucleotide sequence including one or more nucleotide substitutions relative to a nucleotide sequence selected from SEQ ID NOs:1308-1395, 1563-1570, 1725-1727.

Embodiment 242: The polynucleotide of any one of embodiments 238-239, wherein the polynucleotide includes a chimeric polynucleotide.

Embodiment 243: The polynucleotide of any one of embodiments 238-242, wherein the polynucleotide has a nucleotide sequence with at least 60% sequence identity with one of SEQ ID NOs:1308-1395, 1563-1570, 1725-1727.

Embodiment 244: An expression vector including the polynucleotide of any one of embodiments 238-243.

Embodiment 245: An engineered non-plant cell including the expression vector of embodiment 244.

Embodiment 246: The engineered non-plant cell of embodiment 245, wherein the engineered non-plant cell is an engineered microbial cell.

Embodiment 247: A method of producing a nepetalactol oxidoreductase (NOR), wherein the method includes: culturing the engineered non-plant cell of any one of embodiments 205, 212, 245 or 246 under conditions suitable for expressing the nepetalactol oxidoreductase (NOR); or expressing the polynucleotide of any one of embodiments 238-243 in a cell-free protein synthesis system.

Embodiment 248: An isolated nepetalactol oxidoreductase (NOR) polypeptide including an amino acid sequence that has: at least 70% sequence identity with any one of SEQ ID NOs:520-607, 775-782, 1642-1644.

Embodiment 249: An isolated nepetalactol oxidoreductase (NOR) polypeptide including an amino acid sequence that has: more than 90% sequence identity with any one of SEQ ID NOs:520-607, 775-782, 1642-1644.

Embodiment 250: The isolated nepetalactol oxidoreductase (NOR) polypeptide of embodiment 249, wherein the polypeptide includes an amino acid sequence including one or more amino acid substitutions relative to an amino acid sequence selected from SEQ ID NOs: 520-607, 775-782, 1642-1644.

Embodiment 251: The isolated nepetalactol oxidoreductase (NOR) polypeptide of embodiment 34, wherein the nepetalactol oxidoreductase (NOR) polypeptide has an amino acid sequence with at least 95% sequence identity with an amino acid sequence selected from SEQ ID NOs: 520-607, 775-782, 1642-1644.

Embodiment 252: A method of oxidizing nepetalactol to nepetalactone, wherein the nepetalactol oxidoreductase (NOR) expressed by the engineered non-plant cell of any one of embodiments 205, 212, 245 or 246 or the nepetalactol oxidoreductase (NOR) polypeptide of any one of embodiments 248-251 is contacted with nepetalactol in the presence of nicotinamide adenine dinucleotide (NAD+) or nicotinamide adenine dinucleotide phosphate (NADP+).

Embodiment 253: The method of embodiment 252, wherein the nepetalactol oxidoreductase (NOR) contacted with nepetalactol is expressed by the engineered non-plant cell of any one of embodiments 205, 212, 245 or 246.

Embodiment 254: The method of embodiment 253, wherein the nepetalactol oxidoreductase (NOR) contacted with nepetalactol is expressed by the engineered non-plant cell of embodiment 205 or embodiment 245.

Embodiment 255: The method of embodiment 252, wherein the nepetalactol oxidoreductase (NOR) contacted with nepetalactol is expressed by the engineered non-plant cell of embodiment 212 or embodiment 246.

Embodiment 256: The method of any one of embodiments 253-255, wherein the nepetalactol oxidoreductase (NOR) oxidizes nepetalactol to nepetalactone intracellularly.

Embodiment 257: The method of any one of embodiments 253-255, wherein the nepetalactol oxidoreductase (NOR) oxidizes nepetalactol to nepetalactone in a cell culture medium.

Embodiment 258: The method of any one of embodiments 253-255, wherein the method includes purifying the nepetalactol oxidoreductase (NOR) to produce an enzyme preparation, and adding NAD+ or NADP+ and nepetalactol to the enzyme preparation, wherein the nepetalactol oxidoreductase (NOR) polypeptide oxidizes nepetalactol to nepetalactone in vitro.

Embodiment 259: The method of embodiment 252, wherein the nepetalactol oxidoreductase (NOR) contacted with nepetalactol is the nepetalactol oxidoreductase (NOR) polypeptide of any one of embodiments 248-251, wherein the nepetalactol oxidoreductase (NOR) polypeptide oxidizes nepetalactol to nepetalactone in vitro.

Embodiment 260: The method of embodiment 259, wherein the nepetalactol oxidoreductase (NOR) polypeptide is produced in a cell-free protein synthesis system.

Embodiment 261: The method of embodiment 260, wherein the method includes purifying the nepetalactol oxidoreductase (NOR) polypeptide to produce an enzyme preparation and adding NAD+ or NADP+ and nepetalactol to the enzyme preparation.

Embodiment 262: The method of any of embodiments 252-261, wherein the method additionally includes converting nepetalactone to dihydronepetalactone.

Embodiment 263: The method of embodiment 262, wherein nepetalactone is converted to dihydronepetalactone by contacting nepetalactone with hydrogen and a hydrogenation catalyst.

Embodiment 264: An engineered non-plant cell, wherein the engineered non-plant cell is capable of producing (6E)-8-hydroxygeraniol and expresses a non-native nepetalactol oxidoreductase (NOR).

Embodiment 265: An engineered cell, wherein the engineered cell expresses a non-native nepetalactol synthase (NEPS).

Embodiment 266: An engineered cell, wherein the engineered cell includes means for expressing a non-native nepetalactol synthase (NEPS).

Embodiment 267: The engineered cell of embodiment 265 or embodiment 266, wherein the engineered cell is capable of producing nepetalactol.

Embodiment 268: The engineered cell of embodiment 267, wherein the engineered cell has been engineered to produce nepetalactol.

Embodiment 269: The engineered cell of any one of embodiments 265-268, wherein the engineered cell further expresses: 8-hydroxygeraniol oxidoreductase (8-hydroxygeraniol dehydrogenase); and/or iridoid synthase.

Embodiment 270: The engineered cell of any one of embodiments 265-269, wherein the engineered cell further expresses: geranyl diphosphate diphosphatase (geraniol synthase); and geraniol 8-hydroxylase.

Embodiment 271: The engineered cell of any one of embodiments 265-270, wherein the engineered cell includes a microbial cell.

Embodiment 272: The engineered cell of embodiment 271, wherein the microbial cell includes a bacterial cell.

Embodiment 273: The engineered cell of embodiment 272, wherein the bacterial cell is a cell of the genus *Escherichia* or *Corynebacterium*.

Embodiment 274: The engineered cell of embodiment 273, wherein the bacterial cell is a cell of the genus and species *E. coli* or *C. glutamicum*.

Embodiment 275: The engineered cell of embodiment 271, wherein the engineered cell includes a fungal cell.

Embodiment 276: The engineered cell of embodiment 275, wherein the fungal cell includes a yeast cell.

Embodiment 277: The engineered cell of embodiment 276, wherein the yeast cell is a cell of the genus *Saccharomyces* or *Yarrowia*.

Embodiment 278: The engineered cell of embodiment 277, wherein the yeast cell is a cell of the genus and species *S. cerevisiae* or *Y. lipolytica*.

Embodiment 279: A culture of engineered cells according to any one of embodiments 265-278.

Embodiment 280: The culture of embodiment 279, wherein the engineered cells are present in a concentration such that the culture has an optical density at 600 nm of 1-500, optionally wherein the optical density is measured without concentrating cells.

Embodiment 281: The culture of embodiment 279 or embodiment 280, wherein the culture includes nepetalactol.

Embodiment 282: The culture of embodiment 281, wherein the nepetalactol includes (4aS,7S,7aR)-nepetalactol, and the culture does not comprise any other stereoisomer of nepetalactol that is detectable by liquid chromatography-mass spectrometry.

Embodiment 283: A method of culturing engineered cells according to any one of embodiments 265-278, the method including culturing the cells under suitable conditions, whereby the engineered cells produce nepetalactol.

Embodiment 284: The method of embodiment 283, wherein the method includes fed-batch culture, with an initial sugar level in the range of 1-100 g/L, followed by controlled sugar feeding.

Embodiment 285: The method of embodiment 283 or embodiment 284, wherein the fermentation substrate includes sugar and a nitrogen source selected from the group consisting of urea, an ammonium salt, ammonia, and any combination thereof.

Embodiment 286: The method of any one of embodiments 283-285, wherein the culture is pH-controlled during culturing.

Embodiment 287: The method of any one of embodiments 283-286, wherein the culture is aerated during culturing.

Embodiment 288: A polynucleotide including a nucleotide sequence that encodes an active nepetalactol synthase (NEPS) including an amino acid sequence that has at least 70% sequence identity with an amino acid sequence selected from SEQ ID NO:718-774.

Embodiment 289: The polynucleotide of embodiment 288, wherein the encoded nepetalactol synthase (NEPS) has at least 95% sequence identity with an amino acid sequence selected from SEQ ID NO:718-774.

Embodiment 290: The polynucleotide of embodiment 288 or embodiment 289, wherein the polynucleotide includes a nucleotide sequence including one or more nucleotide substitutions relative to a nucleotide sequence selected from SEQ ID NOs:1506-1562.

Embodiment 291: The polynucleotide of any one of embodiments 288-290, wherein the polynucleotide includes a chimeric polynucleotide.

Embodiment 292: The polynucleotide of any one of embodiments 289-291, wherein the polynucleotide includes a nucleotide sequence with at least 60% sequence identity with one of SEQ ID NOs:1506-1562.

Embodiment 293: An expression vector including the polynucleotide of any one of embodiments 288-292.

Embodiment 294: An engineered cell including the expression vector of embodiment 293.

Embodiment 295: The engineered cell of embodiment 294, wherein the engineered cell is an engineered microbial cell.

Embodiment 296: A method of producing a nepetalactol synthase (NEPS), wherein the method includes: culturing the engineered cell of embodiment 294 or embodiment 295 under conditions suitable for expressing the nepetalactol synthase (NEPS); or expressing the polynucleotide of any one of embodiments 288-292 in a cell-free protein synthesis system.

Embodiment 297: An isolated nepetalactol synthase (NEPS) polypeptide including an amino acid sequence that has at least 70% sequence identity with an amino acid sequence selected from SEQ ID NO:718-774.

Embodiment 298: The isolated nepetalactol synthase (NEPS) polypeptide of embodiment 297, wherein the polypeptide includes an amino acid sequence including one or more amino acid substitutions relative to an amino acid sequence selected from SEQ ID NO:718-774.

Embodiment 299: The isolated nepetalactol synthase (NEPS) polypeptide of embodiment 297, wherein the nepetalactol synthase (NEPS) polypeptide has an amino acid sequence with at least 95% sequence identity with an amino acid sequence selected from SEQ ID NO:718-774.

Embodiment 300: An engineered cell, wherein the engineered cell expresses: a non-native 8-hydroxygeraniol oxidoreductase (8HGO), wherein the non-native 8HGO has an amino acid sequence that has at least 70% sequence identity with an amino acid sequence selected from SEQ ID NOs: 330-368; and/or a non-native iridoid synthase (ISY), wherein the non-native ISY has an amino acid sequence that has at least 70% sequence identity with an amino acid sequence selected from the group consisting of SEQ ID NOs:369-519, 1695-1724.

Embodiment 301: The engineered cell of embodiment 300, wherein the engineered cell expresses a non-native 8HGO, wherein the non-native 8HGO has an amino acid sequence that has at least 75% sequence identity with an amino acid sequence selected from SEQ ID NOs:330-368.

Embodiment 302: The engineered cell of embodiment 300, wherein the engineered cell expresses a non-native ISY, wherein the non-native ISY has an amino acid sequence that has at least 75% sequence identity with an amino acid sequence selected from the group consisting of SEQ ID NOs:369-519, 1695-1724.

Embodiment 303: The engineered cell of any one of embodiments 300-302, wherein the engineered cell is capable of producing nepetalactol.

Embodiment 304: The engineered cell of embodiment 303, wherein the engineered cell has been engineered to produce nepetalactol.

Embodiment 305: The engineered cell of any one of embodiments 300-304, wherein the engineered cell further expresses a nepetalactol synthase (NEPS).

Embodiment 306: The engineered cell of any one of embodiments 300-304, wherein the engineered cell further expresses: geranyl diphosphate diphosphatase (geraniol synthase); and geraniol 8-hydroxylase.

Embodiment 307: The engineered cell of any one of embodiments 300-306, wherein the engineered cell includes a microbial cell.

Embodiment 308: The engineered cell of embodiment 307, wherein the microbial cell includes a bacterial cell.

Embodiment 309: The engineered cell of embodiment 308, wherein the bacterial cell is a cell of the genus *Escherichia* or *Corynebacterium*.

Embodiment 310: The engineered cell of embodiment 309, wherein the bacterial cell is a cell of the genus and species *E. coli* or *C. glutamicum*.

Embodiment 311: The engineered cell of embodiment 307, wherein the engineered cell includes a fungal cell.

Embodiment 312: The engineered cell of embodiment 311, wherein the fungal cell includes a yeast cell.

Embodiment 313: The engineered cell of embodiment 312, wherein the yeast cell is a cell of the genus *Saccharomyces* or *Yarrowia*.

Embodiment 314: The engineered cell of embodiment 313, wherein the yeast cell is a cell of the genus and species *S. cerevisiae* or *Y. lipolytica*.

Embodiment 315: A culture of engineered cells according to any one of embodiments 300-314.

Embodiment 316: The culture of embodiment 91, wherein the engineered cells are present in a concentration such that the culture has an optical density at 600 nm of 1-500, optionally wherein the optical density is measured without concentrating cells.

Embodiment 317: The culture of embodiment 315 or embodiment 316, wherein the culture includes nepetalactol.

Embodiment 318: The culture of embodiment 317, wherein the nepetalactol includes (4aS,7S,7aR)-nepetalactol, and the culture does not comprise any other stereoisomer of nepetalactol that is detectable by liquid chromatography-mass spectrometry.

Embodiment 319: A method of culturing engineered cells according to any one of embodiments 300-314, the method including culturing the cells under suitable conditions, whereby the engineered cells produce nepetalactol.

Embodiment 320: The method of embodiment 319, wherein the method includes fed-batch culture, with an initial sugar level in the range of 1-100 g/L, followed by controlled sugar feeding.

Embodiment 321: The method of embodiment 319 or embodiment 320, wherein the fermentation substrate includes sugar and a nitrogen source selected from the group consisting of urea, an ammonium salt, ammonia, and any combination thereof.

Embodiment 322: The method of any one of embodiments 319-321, wherein the culture is pH-controlled during culturing.

Embodiment 323: The method of any one of embodiments 319-322, wherein the culture is aerated during culturing.

Embodiment 324: A polynucleotide including a nucleotide sequence that encodes: an active 8-hydroxygeraniol oxidoreductase (8HGO) including an amino acid sequence that has at least 70% sequence identity with an amino acid sequence selected from the group consisting of SEQ ID NOs:330-368; or an active iridoid synthase (ISY) including an amino acid sequence that has at least 70% sequence identity with an amino acid sequence selected from the group consisting of SEQ ID NOs:369-519, 1695-1724.

Embodiment 325: The polynucleotide of embodiment 324, wherein the nucleotide sequence encodes an active 8HGO including an amino acid sequence that has at least 75% sequence identity with an amino acid sequence selected from the group consisting of SEQ ID NOs:330-368.

Embodiment 326: The polynucleotide of embodiment 324, wherein the nucleotide sequence encodes an active ISY including an amino acid sequence that has at least 75% sequence identity with an amino acid sequence selected from the group consisting of SEQ ID NOs:369-519, 1695-1724.

Embodiment 327: The polynucleotide of any one of embodiments 324-326, wherein the sequence identity is at least 95%.

Embodiment 328: The polynucleotide of embodiment any one of embodiments 324-327, wherein the polynucleotide includes a nucleotide sequence including one or more nucleotide substitutions relative to a nucleotide sequence selected from the group consisting of SEQ ID NOs:1157-1307, 1778-1807.

Embodiment 329: The polynucleotide of any one of embodiments 324-328, wherein the polynucleotide includes a chimeric polynucleotide.

Embodiment 330: The polynucleotide of any one of embodiments 327-329, wherein the polynucleotide encodes an active 8HGO and includes a nucleotide sequence with at least 60% sequence identity with a nucleotide sequence selected from the group consisting of SEQ ID NOs:1118-1156.

Embodiment 331: The polynucleotide of any one of embodiments 327-330, wherein the polynucleotide encodes an active ISY and includes a nucleotide sequence with at least 60% sequence identity with a nucleotide sequence selected from the group consisting of SEQ ID NOs:369-519, 1695-1724.

Embodiment 332: An expression vector including the polynucleotide of any one of embodiments 324-334.

Embodiment 333: An engineered cell including the expression vector of embodiment 332.

Embodiment 334: The engineered cell of embodiment 333, wherein the engineered cell is an engineered microbial cell.

Embodiment 335: A method of producing an enzyme, wherein the method includes: culturing the engineered cell of embodiment 333 or embodiment 334 under conditions suitable for expressing the enzyme; or expressing the polynucleotide of any one of embodiments 324-331 in a cell culture or in a cell-free protein synthesis system.

Embodiment 336: An isolated polypeptide, wherein the isolated polypeptide includes: an active 8HGO polypeptide including an amino acid sequence that has at least 70% sequence identity with an amino acid sequence selected from the group consisting of SEQ ID NOs:330-368; or an active ISY polypeptide including an amino acid sequence that has at least 70% sequence identity with an amino acid sequence selected from the group consisting of SEQ ID NOs:369-519, 1695-1724.

Embodiment 337: The isolated polypeptide of embodiment 336, wherein the isolated polypeptide includes an active 8HGO polypeptide including an amino acid sequence that has at least 75% sequence identity with an amino acid sequence selected from the group consisting of SEQ ID NOs:330-368.

Embodiment 338: The isolated polypeptide of embodiment 336, wherein the isolated polypeptide includes an active ISY polypeptide including an amino acid sequence that has at least 75% sequence identity with an amino acid sequence selected from the group consisting of SEQ ID NOs:369-519, 1695-1724.

Embodiment 339: The isolated polypeptide of any one of embodiments 336-338, wherein the sequence identity is at least 95%.

Embodiment 340: The isolated polypeptide of any one of embodiments 336-339, wherein the polypeptide includes an amino acid sequence including one or more amino acid substitutions relative to an amino acid sequence selected from the group consisting of SEQ ID NOs:330-368 (8HGO), 369-519, 1695-1724 (ISY).

Embodiment 341: The isolated polynucleotide of any one of embodiments 336-340, wherein the polypeptide includes a chimeric polynucleotide.

Embodiment 342: A method, wherein the method includes contacting an enzyme selected from the group consisting of: the 8-hydroxygeraniol oxidoreductase (8HGO) or iridoid synthase expressed by the engineered cell of any one of embodiments 300-314; and the isolated polypeptide of any one of embodiments 336-340; the nepetalactol synthase (NEPS) expressed by the engineered cell of any one of embodiments 265-278; the isolated nepetalactol synthase (NEPS) polypeptide of any one of embodiments 297-299; with a substrate for the enzyme.

Embodiment 343: The method of embodiment 342, the 8HGO or iridoid synthase expressed by the engineered cell of any one of embodiments 300-314 or the isolated polypeptide of any one of embodiments 336-340 is contacted with the substrate, the substrate including 8-oxogeranial for 8HGO or 8-oxogeranial for iridoid synthase.

Embodiment 344: The method of embodiment 342 or embodiment 343, wherein said contacting is carried out in an in vitro reaction mixture.

Embodiment 345: The method of embodiment 344, wherein the enzyme is purified from a cell culture medium before contact with the substrate.

Embodiment 346: The method of embodiment 344, wherein the enzyme includes said isolated polypeptide of any one of embodiments 336-340, wherein the isolated polypeptide is expressed in a cell-free protein synthesis system.

Embodiment 347: The method of embodiment 346, wherein the enzyme is purified before contact with the substrate.

Embodiment 348: The method of embodiment 342, wherein the nepetalactol synthase (NEPS) expressed by the engineered cell of any one of embodiments 265-278 or the nepetalactol synthase (NEPS) polypeptide of any one of embodiments 297-299 is contacted with an enol produced from reduction of 8-oxogeranial.

Embodiment 349: The method of embodiment 348, wherein the nepetalactol synthase (NEPS) is expressed by the engineered cell of any one of embodiments 265-278, or 294-295.

Embodiment 350: The method of embodiment 349, wherein the nepetalactol synthase (NEPS) is expressed by the engineered cell of embodiment 265 or embodiment 294.

Embodiment 351: The method of embodiment 349, wherein the nepetalactol synthase (NEPS) contacted with nepetalactol is expressed by the engineered cell of any one of embodiments 265-278, or 294-295.

Embodiment 352: The method of any one of embodiments 348-351, wherein the nepetalactol synthase (NEPS) is contacted with an enol produced from reduction of 8-oxogeranial in an in vitro reaction mixture.

Embodiment 353: The method of embodiment 352, wherein the in vitro reaction mixture additionally includes an iridoid synthase and nicotinamide adenine dinucleotide (NAD+) or nicotinamide adenine dinucleotide phosphate (NADP+).

Embodiment 354: The method of embodiment 353, wherein the in vitro reaction mixture additionally includes an 8-hydroxygeraniol oxidoreductase (8-hydroxygeraniol dehydrogenase).

Embodiment 355: The method of any one of embodiments 352-354 wherein the method includes purifying the nepetalactol synthase (NEPS) and/or the iridoid synthase or the 8-hydroxygeraniol oxidoreductase, if present, from a cell culture medium to produce an enzyme preparation and combining the enzyme preparation with 8-hydroxygeraniol and NAD+ or NADP+ to produce the in vitro reaction mixture.

Embodiment 356: The method of any one of embodiments 352-354, wherein the method includes producing the nepetalactol synthase (NEPS) and/or the iridoid synthase or the 8-hydroxygeraniol oxidoreductase, if present, in a cell-free protein synthesis system.

Embodiment 357: The method of embodiment 356, wherein the method includes purifying the nepetalactol synthase (NEPS) and/or the iridoid synthase or the 8-hydroxygeraniol oxidoreductase, if present, to produce an enzyme preparation and combining the enzyme preparation with hydroxygeraniol and NAD+ or NADP+ to produce the in vitro reaction mixture.

Embodiment 358: The method of any one of embodiments 342-357, wherein the nepetalactol synthase (NEPS) is the nepetalactol synthase (NEPS) polypeptide of any one of embodiments 297-299.

Embodiment 359: The method of any of embodiments 342-358, wherein the method produces nepetalactol.

Embodiment 360: The method of embodiment 359, wherein the nepetalactol includes (4aS,7S,7aR)-nepetalactol and does not comprise any other stereoisomer of nepetalactol that is detectable by liquid chromatography-mass spectrometry.

Embodiment 361: The method of embodiment 359, wherein the method additionally includes converting the nepetalactol to nepetalactone.

Embodiment 362: The method of embodiment 361, wherein the nepetalactol is converted to nepetalactone by contacting the nepetalactol with a nepetalactone oxidoreductase and NAD+ or NADP+.

Embodiment 363: The method of embodiment 361 or embodiment 362, wherein the method additionally includes converting nepetalactone to dihydronepetalactone.

Embodiment 364: The method of embodiment 363, wherein nepetalactone is converted to dihydronepetalactone by contacting nepetalactone with hydrogen and a hydrogenation catalyst.

Embodiment 365: An engineered cell or a reaction mixture, the engineered cell or reaction mixture including a set of active enzymes including: an active 8-hydroxygeraniol oxidoreductase (8HGO; 8-hydroxygeraniol dehydrogenase), wherein the active 8HGO has an amino acid sequence that has at least 70% sequence identity with an amino acid sequence selected from the group consisting of SEQ ID NOs:330-368; an active iridoid synthase (ISY), wherein the active ISY has an amino acid sequence that has at least 70% sequence identity with an amino acid sequence selected from the group consisting of SEQ ID NOs:369-519, 1695-1724; and an active nepetalactol synthase (NEPS), wherein the active NEPS has an amino acid sequence that has at least 70% sequence identity with an amino acid sequence selected from the group consisting of SEQ ID NOs:718-774.

Embodiment 366: An engineered cell or a reaction mixture, the engineered cell or reaction mixture including a set of active enzymes including: an active 8-hydroxygeraniol oxidoreductase (8HGO; 8-hydroxygeraniol dehydrogenase), wherein the active 8HGO is encoded by a nucleotide sequence that has at least 60% sequence identity with a nucleotide sequence selected from the group consisting of SEQ ID NOs:1118-1156; an active iridoid synthase (ISY), wherein the active ISY is encoded by a nucleotide sequence that has at least 60% sequence identity with a nucleotide sequence selected from the group consisting of SEQ ID NOs:369-519, 1695-1724; and an active nepetalactol synthase (NEPS), wherein the active NEPS is encoded by a nucleotide sequence that has at least 60% sequence identity with a nucleotide sequence selected from the group consisting of SEQ ID NOs: 1506-1562.

Embodiment 367: The engineered cell or reaction mixture of embodiment 365 or embodiment 366, wherein the active 8HGO has an amino acid sequence that has at least 70% sequence identity with an amino acid sequence selected from the group consisting of SEQ ID NOs:330-368.

Embodiment 368: The engineered cell or reaction mixture of embodiment 365 or embodiment 366, wherein the active 8HGO includes an amino acid sequence selected from the group consisting of SEQ ID NOs: 330-368.

Embodiment 369: The engineered cell or reaction mixture of any one of embodiments 365-368, wherein the active ISY has an amino acid sequence that has at least 70% sequence identity with an amino acid sequence selected from the group consisting of SEQ ID NOs:369-519, 1695-1724.

Embodiment 370: The engineered cell or reaction mixture of any one of embodiments 365-368, wherein the active ISY includes an amino acid sequence selected from the group consisting of SEQ ID NOs: 369-519, 1695-1724.

Embodiment 371: The engineered cell or reaction mixture of any one of embodiments 365-370, wherein the active NEPS has an amino acid sequence that has at least 70% sequence identity with an amino acid sequence selected from the group consisting of SEQ ID NOs:718-774.

Embodiment 372: The engineered cell or reaction mixture of any one of embodiments 365-370, wherein the active NEPS includes any one of SEQ ID NOs: 718-774.

Embodiment 373: The engineered cell or reaction mixture of any one of embodiments 365-372, which is an engineered microbial cell.

Embodiment 374: The engineered microbial cell of embodiment 373, wherein the engineered microbial cell is capable of producing nepetalactol.

Embodiment 375: The engineered microbial cell of embodiment 374, wherein the engineered microbial cell includes a bacterial cell.

Embodiment 376: The engineered microbial cell of embodiment 375, wherein the bacterial cell is a cell of the genus *Escherichia* or *Corynebacterium*.

Embodiment 377: The engineered microbial cell of embodiment 376, wherein the bacterial cell is a cell of the genus and species *E. coli* or *C. glutamicum*.

Embodiment 378: The engineered microbial cell of any one of embodiments 374, wherein the engineered microbial cell includes a fungal cell.

Embodiment 379: The engineered microbial cell of embodiment 378, wherein the fungal cell includes a yeast cell.

Embodiment 380: The engineered microbial cell of embodiment 379, wherein the yeast cell is a cell of the genus *Saccharomyces* or *Yarrowia*.

Embodiment 381: The engineered microbial cell of embodiment 380, wherein the bacterial cell is a cell of the genus and species *S. cerevisiae* or *Y. lipolytica*.

Embodiment 382: A culture of engineered microbial cells according to any one of embodiments 373-381.

Embodiment 383: The culture of embodiment 382, wherein the substrate includes a carbon source and a nitrogen source selected from the group consisting of urea, an ammonium salt, ammonia, and any combination thereof.

Embodiment 384: The culture of embodiment 382 or embodiment 383, wherein the engineered microbial cells are present in a concentration such that the culture has an optical density at 600 nm of 1-500, optionally wherein the optical density is measured without concentrating cells.

Embodiment 385: The culture of any one of embodiments 382-384, wherein the culture includes nepetalactol.

Embodiment 386: The culture of embodiment 385, wherein the nepetalactol includes (4aS,7S,7aR)-nepetalactol, and the culture does not comprise any other stereoisomer of nepetalactol that is detectable by liquid chromatography-mass spectrometry.

Embodiment 387: A method of culturing engineered microbial cells according to any one of embodiments 373-381, the method including culturing the cells under suitable conditions, whereby the engineered microbial cells produce nepetalactol.

Embodiment 388: The method of embodiment 287, wherein the method includes fed-batch culture, with an initial sugar level in the range of 1-100 g/L, followed by controlled sugar feeding.

Embodiment 389: The method of embodiment 287 or embodiment 288, wherein the fermentation substrate includes sugar and a nitrogen source selected from the group consisting of urea, an ammonium salt, ammonia, and any combination thereof.

Embodiment 390: The method of any one of embodiments 287-289, wherein the culture is pH-controlled during culturing.

Embodiment 391: The method of any one of embodiments 287-290, wherein the culture is aerated during culturing.

Embodiment 392: The engineered cell or reaction mixture of any one of embodiments 365-373, which is a reaction mixture additionally including nicotinamide adenine dinucleotide (NAD+) or nicotinamide adenine dinucleotide phosphate (NADP+).

Embodiment 393: The reaction mixture of embodiment 392, wherein the reaction mixture produces nepetalactol.

Embodiment 394: A method of producing nepetalactol using a culture according to embodiments 382-391 or a reaction mixture according to embodiment 392 or embodiment 393.

Embodiment 395: The method of embodiment 394, wherein the method additionally includes converting the nepetalactol to nepetalactone.

Embodiment 396: The method of embodiment 395, wherein the nepetalactol is converted to nepetalactone by contacting the nepetalactol with a nepetalactone oxidoreductase and NAD+ or NADP+.

Embodiment 397: The method of embodiment 396, wherein the method additionally includes converting nepetalactone to dihydronepetalactone.

Embodiment 398: The method of embodiment 397, wherein nepetalactone is converted to dihydronepetalactone by contacting nepetalactone with hydrogen and a hydrogenation catalyst.

Embodiment 399: A cell culture medium including nepetalactol, wherein the nepetalactol includes (4aS,7S,7aR)-nepetalactol, and the cell culture medium does not comprise any other stereoisomer of nepetalactol that is detectable by liquid chromatography-mass spectrometry.

Embodiment 400: Nepetalactol purified from the cell culture medium of embodiment 399.

Embodiment 401: Nepetalactol produced from an in vitro reaction mixture, wherein the nepetalactol includes (4aS,7S,7aR)-nepetalactol and does not comprise any other stereoisomer of nepetalactol that is detectable by liquid chromatography-mass spectrometry.

Embodiment 402: Nepetalactone produced by conversion of the nepetalactol of embodiment 400 or embodiment 401 to nepetalactone.

Embodiment 403: An isolated polypeptide sequence that encodes an active enzyme, wherein the active enzyme has an amino acid sequence that has at least 70% sequence identity with an amino acid sequence encoded by nucleotide sequence selected from the group consisting of: SEQ ID NOs:789-927, wherein the active enzyme is a geranyl diphosphate synthase (GPPS); SEQ ID NOs:928-1037, wherein the active enzyme is a geranyl diphosphate diphosphatase (geraniol synthase, GES); SEQ ID NOs:1038-1072, 1088-1110, wherein the active enzyme is a geraniol 8-hydroxylase (G8H); SEQ ID NOs:1073-1087, wherein the active enzyme is a cytochrome P450 reductase (CPR) capable of promoting regeneration of the redox state of the G8H; SEQ ID NOs:1111-1117, wherein the active enzyme is a cytochrome B5 (CYB5) capable of promoting regeneration of the redox state of the G8H; SEQ ID NOs:1118-1156, wherein the active enzyme is an 8-hydroxygeraniol dehydrogenase (8HGO); SEQ ID NOs:1157-1307, 1778-1807, wherein the active enzyme is an iridoid synthase (ISY); SEQ ID NOs:1308-1395, 1563-1570, 1725-1727, wherein the active enzyme is a nepetalactol oxidoreductase (NOR); SEQ ID NOs:1571-1576, wherein the active enzyme is a cytochrome B5 reductase (CYBSR); SEQ ID NOs:1506-1562, wherein the active enzyme is a nepetalactol synthase (NEPS); SEQ ID NOs:1396-1397, 1728-1777, wherein the active enzyme is a GPPS-GES fusion; SEQ ID NOs:1398-1462, wherein the active enzyme is a G8H-CPR fusion; SEQ ID NOs:1463-1481, wherein the active enzyme is a G8H-CPR-CYB5 fusion; SEQ ID NOs:1482-1493, wherein the active enzyme is a 8HGO-ISY fusion; or SEQ ID NOs:1494-1505, wherein the active enzyme is a ISY-NEPS fusion; wherein the enzyme-encoding nucleotide sequence is operably linked to a promoter sequence selected from the group consisting of SEQ ID NOs:1577-1633 or a terminator sequence selected from the group consisting of SEQ ID NOs:1634-1641.

Embodiment 404: The polypeptide sequence of embodiment 403, wherein the polypeptide is heterologously expressed in a microbial host cell.

Embodiment 405: The polypeptide sequence of embodiment 404, wherein the host cell is a bacterial cell or a yeast cell.

Embodiment 406: The polypeptide sequence of any one of embodiments 404-405, wherein the host cell is capable of producing nepetalactol and/or nepetalactone.

BRIEF DESCRIPTION OF THE DRAWINGS

(In FIGS. 2A-B, "uM" is used to refer to "µM.")

(In FIG. 4, "ug" is used to refer to "µg."). See Example 4.

(In FIG. 5, "ug" is used to refer to "µg."). See Example 5.

FIG. 6A-C: Production of nepetalactol and nepetalactone in engineered Saccharomyces cerevisiae strains. (A) Titers of nepetalactol and nepetalactone in engineered strains compared to wild-type and a non-inoculated control. Geraniol or 8-hydroxygeraniol were provided as substrate feeds (i.e., carbon sources) at a final concentration of 500 mg/L. Only the cis,trans-nepetalactone isomer was produced. (B) Strain genotypes of engineered strains. Gene deletions are indicated by Δ. "ihol1" indicates that the cassette has been integrated at a neutral loci, specifically, an intergenic region between HOL1 and a proximal gene. (C) Gene names and their corresponding source organisms that were introduced into the engineered strains. See Example 2.

DETAILED DESCRIPTION

Figure 1A:
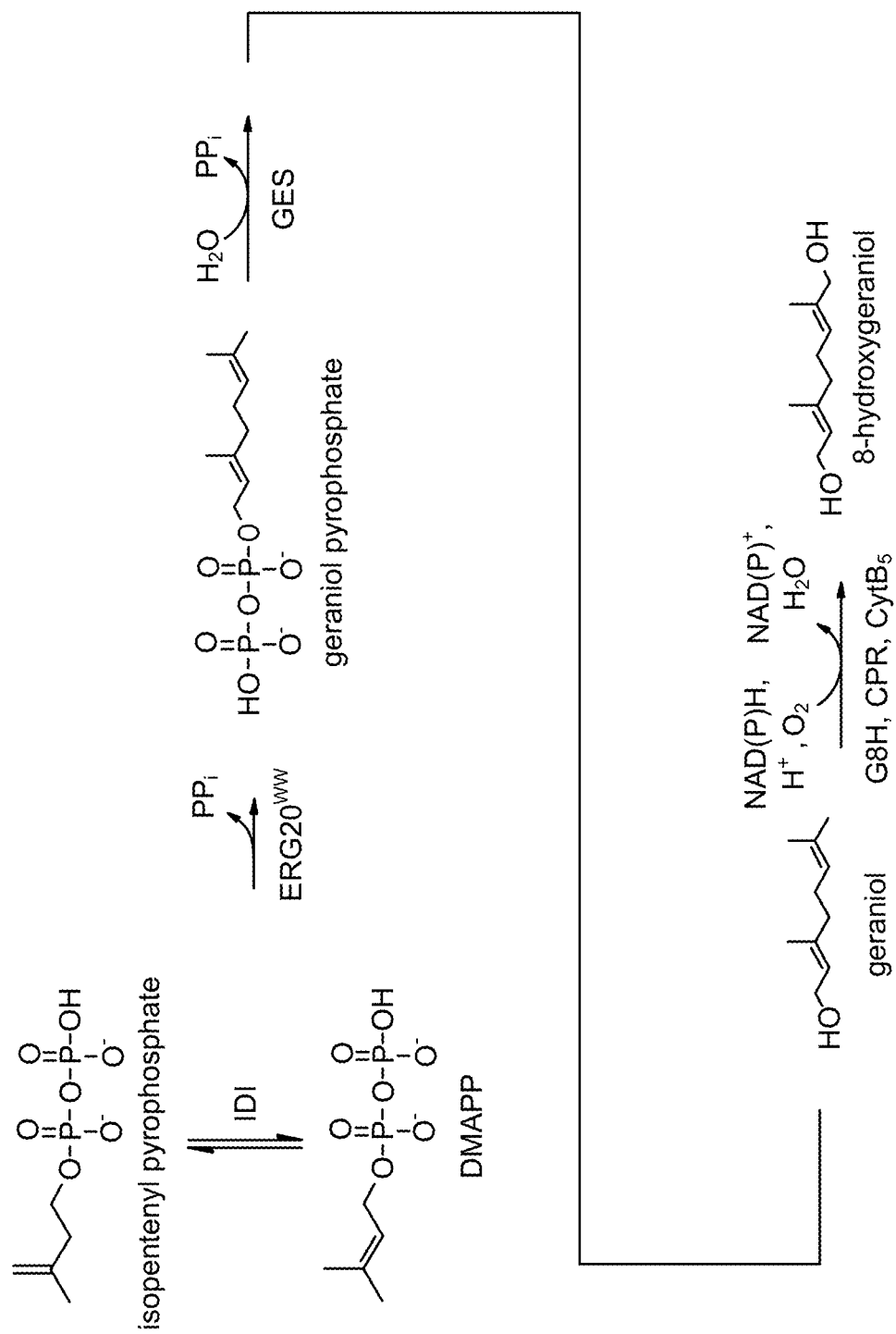
FIG. 1A-B: Nepetalactone biosynthetic pathway (A) Conversion of the native precursor metabolites, dimethylallyl pyrophosphate (DMAPP) and isopentenyl pyrophosphate (IPP) into 8-hydroxygeraniol. (B) Conversion of 8-hydroxygeraniol to nepetalactone. Prior to work described herein, cyclization of the enol intermediate into nepetalactol was thought to be catalyzed by ISY or occur spontaneously in planta. The work described here shows that a novel enzyme, nepetalactol synthase (NEPS), acts as a cyclase and significantly enhances this reaction in vitro and in vivo. In addition, NEPSs control the stereochemistry of cyclization and different NEPS can specifically produce any one of the four depicted nepetalactol stereoisomers. Nepetalactol is converted to nepetalactone by a previously uncharacterized oxidoreductase (nepetalactol oxidoreductase, NOR).

The present disclosure enables biosynthesis of nepetalactone in a microbial host. This biosynthetic pathway is capable of converting glucose or other fed intermediates to the final product, nepetalactone.

Also described herein are the nucleotide and amino acid sequences of nepetalactol oxidoreductases (NORs), which were found to catalyze the conversion of nepetalactol to nepetalactone in vitro in the presence of NAD+ or NADP+. The identification of these enzymes provides a biosynthetic path from nepetalactol to nepetalactone. The NORs may be heterologously expressed in a microbial host that harbors a nepetalactol pathway for production of nepetalactone, or expressed in a cell-free or microbial system and purified for chemoenzymatic conversion of nepetalactol into nepetalactone in the presence of NAD+ or NADP+. This bioconversion provides a greener and cheaper alternative to chemical conversion that decreases the total number of process steps required for industrial-scale manufacturing.

Definitions

Terms used in the claims and specification are defined as set forth below unless otherwise specified.

The term "fermentation" is used herein to refer to a process whereby a microbial cell converts one or more substrate(s) into a desired product by means of one or more biological conversion steps, without the need for any chemical conversion step.

The term "engineered" is used herein, with reference to a cell, to indicate that the cell contains at least one targeted genetic alteration introduced by man that distinguishes the engineered cell from the naturally occurring cell.

The terms "polypeptide," "peptide," and "protein" refer to a polymer of amino acid residues. The terms apply to amino acid polymers in which one or more amino acid residue is an artificial chemical analogue of a corresponding naturally occurring amino acid, as well as to naturally occurring amino acid polymers. Typical peptides/polypeptides/proteins are chains of amino acids whose α carbons are linked through peptide bonds. However, the term also includes variants on the traditional peptide linkage joining the amino acids making up the polypeptide. The terminal amino acid at one end of the chain (amino terminal) therefore has a free amino group, while the terminal amino acid at the other end of the chain (carboxy terminal) has a free carboxyl group. Proteins also include essentially any polyamino acid including, but not limited to peptide mimetics such as amino acids joined by an ether as opposed to an amide bond. Typically, any of the protein sequences provided herein comprise all "L" amino acids. However, in certain embodiments, any of the protein sequences provided herein can comprise a combination of "L" and "D" amino acids. In certain embodiments any of the protein sequences described herein comprise all "D" amino acids thereby providing the D-enantiomer or inverso form of the protein. In certain embodiments any of the protein sequences described herein comprise a retro-protein in which the amino acids are all "L" amino acids, but in a reverse order. In certain embodiments any of the protein sequences described herein comprise a retro-inverso protein composed of all "D" amino acids in a reverse order.

As used herein, the term "amino terminus" (abbreviated N-terminus) refers to the free α-amino group on an amino acid at the amino terminal of a protein or to the α-amino group (imino group when participating in a peptide bond) of an amino acid at any other location within the protein.

The term "carboxy terminus" refers to the free carboxyl group on the carboxy terminus of a protein or the carboxyl group of an amino acid at any other location within the protein.

The terms "polynucleotide," "oligonucleotide," and "nucleic acid" includes any form of DNA or RNA, including, for example, genomic DNA; complementary DNA (cDNA), which is a DNA representation of mRNA, usually obtained by reverse transcription of messenger RNA (mRNA) or by amplification; DNA molecules produced synthetically or by amplification; and mRNA. Polynucleotides/oligonucleotides/nucleic acids encompass double- or triple-stranded nucleic acids, as well as single-stranded molecules. In double- or triple-stranded nucleic acids, the nucleic acid strands need not be coextensive (i.e., a double-stranded nucleic acid need not be double-stranded along the entire length of both strands). Polynucleotides/oligonucleotides/nucleic acids also encompass any chemical modification thereof, such as by methylation and/or by capping. Illustrative modifications can include addition of chemical groups that incorporate additional charge, polarizability, hydrogen bonding, electrostatic interaction, and/or functionality to the individual nucleotide bases or to the polynucleotide as a whole. Such modifications may include base modifications such as 2'-position sugar modifications, 5-position pyrimidine modifications, 8-position purine modifications, modifications at cytosine exocyclic amines, substitutions of 5-bromo-uracil, backbone modifications, unusual base pairing combinations such as the isobases isocytidine and isoguanidine, and the like. Polynucleotides/oligonucleotides/nucleic acids can be derived from a completely chemical synthesis process, such as a solid phase-mediated chemical synthesis, from a biological source, such as through isolation from any species that produces nucleic acid, or from processes that involve the manipulation of nucleic acids by molecular biology tools, such as DNA replication, amplification (e.g., PCR), reverse transcription, or from a combination of any of these processes.

As used with reference to a polynucleotide or a polypeptide, the term "chimeric" indicates that the polynucleotide or polypeptide includes at least two sub-sequences that are not naturally found together in a single molecule. Chimeric polypeptides are also termed "fusion proteins."

The term "native" used herein to refer to a cellular component, such as a polynucleotide or polypeptide, that is naturally present in a particular cell. A native polynucleotide or polypeptide is endogenous to the cell.

The term "isolated" is used herein with reference to a cellular component or product, such as a polynucleotide or polypeptide, to indicate that the cellular component has been separated from at least one other component that normally accompanies it as found in its native state. This term encompasses, for example, a polynucleotide that is separated from sequences that normally flank the polynucleotide in nature, as well as a polynucleotide introduced into a cell that does not naturally contain it.

In some embodiments, a cellular component or product is "purified," which indicates that the cellular component or product is substantially free from all other components/products that normally accompany it as found in its native state. In some embodiments, the cellular component is a protein that is purified to homogeneity, such that no other components that normally accompany it can be detected on a silver-stained gel.

When used with reference to a polynucleotide or polypeptide, the term "non-native" refers to a polynucleotide or polypeptide that is not naturally present in a particular cell.

When used with reference to the context in which a gene is expressed, the term "non-native" refers to a gene expressed in any context other than the genomic and cellular context in which it is naturally expressed. A gene expressed in a non-native manner may have the same nucleotide sequence as the corresponding gene in a host cell, but may be expressed from a vector or from an integration point in the genome that differs from the locus of the native gene.

The term "heterologous" is used herein to describe a polynucleotide or polypeptide introduced into a host cell. This term encompasses a polynucleotide or polypeptide, respectively, derived from a different organism, species, or strain than that of the host cell. In this case, the heterologous polynucleotide or polypeptide has a sequence that is different from any sequence(s) found in the same host cell. However, the term also encompasses a polynucleotide or polypeptide that has a sequence that is the same as a sequence found in the host cell, wherein the polynucleotide or polypeptide is present in a different context than the native sequence (e.g., a heterologous polynucleotide can be linked to a different promotor and inserted into a different genomic location than that of the native sequence). "Heterologous expression" thus encompasses expression of a sequence that is non-native to the host cell, as well as expression of a sequence that is native to the host cell in a non-native context.

As used with reference to polynucleotides or polypeptides, the term "wild-type" refers to any polynucleotide having a nucleotide sequence, or polypeptide having an amino acid, sequence present in a polynucleotide or polypeptide from a naturally occurring organism, regardless of the source of the molecule; i.e., the term "wild-type" refers to sequence characteristics, regardless of whether the molecule is purified from a natural source; expressed recombinantly, followed by purification; or synthesized. The term "wild-type" is also used to denote naturally occurring cells.

Enzymes are identified herein by the reactions they catalyze and, unless otherwise indicated, refer to any polypeptide capable of catalyzing the identified reaction. Unless otherwise indicated, enzymes may be derived from any organism and may have a native or mutated amino acid sequence. As is well known, enzymes may have multiple functions and/or multiple names, sometimes depending on the source organism from which they derive. The enzyme names used herein encompass orthologs, including enzymes that may have one or more additional functions or a different name.

The term "feedback-deregulated" is used herein with reference to an enzyme that is normally negatively regulated by a downstream product of the enzymatic pathway (i.e., feedback-inhibition) in a particular cell. In this context, a "feedback-deregulated" enzyme is a form of the enzyme that is less sensitive to feedback-inhibition than the native enzyme native to the cell. A feedback-deregulated enzyme may be produced by introducing one or more mutations into a native enzyme. Alternatively, a feedback-deregulated enzyme may simply be a heterologous, native enzyme that, when introduced into a particular microbial cell, is not as sensitive to feedback-inhibition as the native, native enzyme. In some embodiments, the feedback-deregulated enzyme shows no feedback-inhibition in the microbial cell.

The term "nepetalactol" refers to all stereoisomers of nepetalactol, for example, (4aS,7S,7aR)-4,7-Dimethyl-1,4a,5,6,7,7a-hexahydrocyclopenta[c]pyran-1-ol.

The term "nepetalactone" refers to all stereoisomers of nepetalactone, for example, 4,7-Dimethyl-5,6,7,7a-tetrahydrocyclopenta[c]pyran-1(4aH)-one (CAS No. 490-10-8).

The term "dihydronepetalactone" refers to all stereoisomers of dihydronepetalactone, for example, (4 S,4 aR,7 S,7aR)-4,7-dimethyl-4,4a,5,6,7,7a-hexahydro-3H-cyclopenta[c] pyran-1-one.

The term "sequence identity," in the context of two or more amino acid or nucleotide sequences, refers to two or more sequences that are the same or have a specified percentage of amino acid residues or nucleotides that are the same, when compared and aligned for maximum correspondence, as measured using a sequence comparison algorithm or by visual inspection.

For sequence comparison to determine percent nucleotide or amino acid sequence identity, typically one sequence acts as a "reference sequence," to which a "test" sequence is compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence relative to the reference sequence, based on the designated program parameters. Alignment of sequences for comparison can be conducted using BLAST set to default parameters.

The term "titer," as used herein, refers to the mass of a product produced in a reaction divided by volume in which the reaction is carried out. For example, to calculate the titer of a product produced by a culture of microbial cells, one can divide the mass of the product by the culture volume. For a product produced in an in vitro reaction using a cell lysate or purified enzyme, one can calculate the titer by dividing the mass of the product by the volume of the reaction mixture.

As used herein with respect to recovering nepetalactone from a cell culture, "recovering" refers to separating the nepetalactone from at least one other component of the cell culture medium.

When used with respect to a NOR, the term "active" means capable of converting nepetalactol to nepetalactone.

As used herein, "overproduction" of nepetalactone refers to production of nepetalactone at a higher level than in a reference organism. A reference organism can be, e.g., an organism that is not naturally capable of producing nepetalactone that has been engineered to have this capability. Further engineering that enhances this production gives rise to engineered organisms that overproduce nepetalactone relative to the initial engineered organism.

Novel Pathway for Microbial Production of Nepetalactone

Figure 1B:
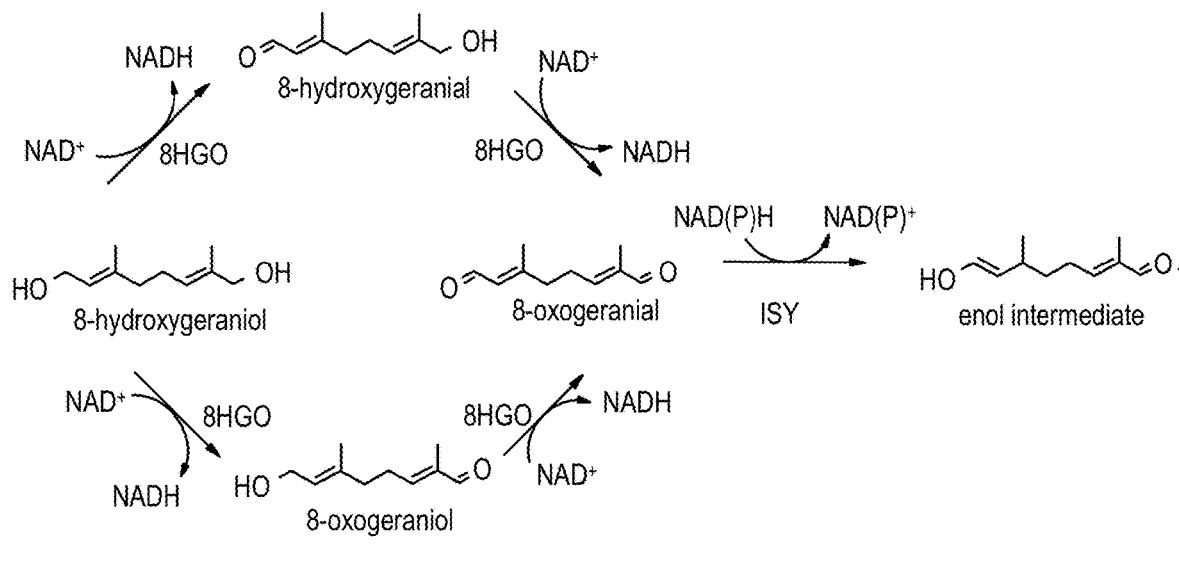
Figure 1B:
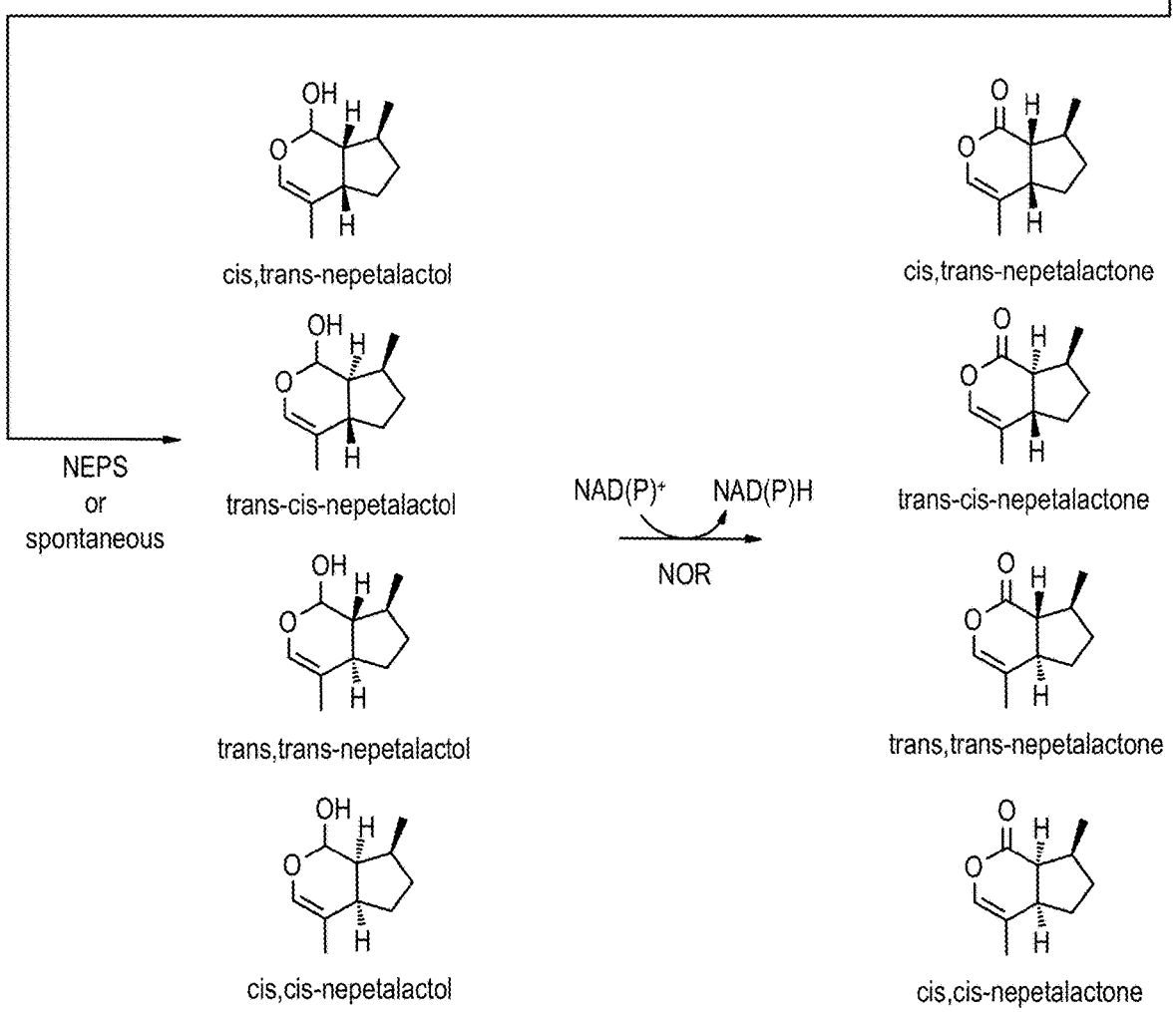

The pathway for producing nepetalactone from the precursor metabolites, dimethylallyl pyrophosphate (DMAPP) and isopentenyl pyrophosphate (IPP) through the intermediate geraniol diphosphate (geraniol-PP or GPP) is shown in FIG. 1. Illustrative nucleotide and amino acid sequences corresponding to the enzymes related to this pathway are found in the Sequence Listing (SEQ ID NOs:1-1576, 1642-1807). The Sequence Listing also provides illustrative promoter (SEQ ID NOs:1577-1633) and terminator sequences (SEQ ID NOs:1634-1641) from *Saccharomyces cerevisiae*, or further engineered, that can be used to express any of these enzymes (e.g., in *Saccharomyces cerevisiae*) in some embodiments. The enzyme(s) to be introduced to reconstitute the nepetalactone pathway in a host cell (e.g., a microbial host cell) depend(s) on the enzymes native to that host cell. In some embodiments, fusion polypeptide(s) may be introduced having the activity of one or more enzyme involved in the production of nepetalactone. These can include one or more of the following enzymes:

Set 1: One or more geraniol diphosphate synthases (GPPS) capable of the condensation of IPP and DMAPP to geranyl diphosphate (GPP); e.g., SEQ ID NOs:789-927 (nucleotide sequences) and SEQ ID NOs:1-139 (amino acid sequences).

Set 2: One or more geraniol synthases (GES) capable of synthesizing geraniol from geranyl diphosphate (GPP); e.g., SEQ ID NOs:928-1037 (nucleotide sequences) and SEQ ID NOs:140-249 (amino acid sequences).

Set 3: One or more geraniol hydroxylases (G8H or G10H) capable of hydroxylation of geraniol to form 8-hydroxygeraniol; e.g., SEQ ID NOs:1038-1072, 1088-1110 (nucleotide sequences) and SEQ ID NOs:250-284, 300-322 (amino acid sequences).

Set 4: One or more cytochrome P450 reductases (CPR) capable of assisting in regeneration of the redox state of the G8H; e.g., SEQ ID NOs:1073-1087 (nucleotide sequences) and SEQ ID NOs:285-299 (amino acid sequences).

Set 5: One or more cytochrome B5 (CYB5 or CytB5) capable of assisting in regeneration of the redox state of the G8H; e.g., SEQ ID NOs:1111-1117 (nucleotide sequences) and SEQ ID NOs:323-329 (amino acid sequences).

Set 6: One or more hydroxygeraniol oxidases (8HGO; also termed hydroxygeraniol oxidases [10HGO], as well as hydroxygeraniol dehydrogenases) capable of oxidation of 8-hydroxygeraniol to 8-oxogeraniol, followed by further oxidation of 8-oxogeraniol to 8-oxogeranial. These enzymes catalyze the oxidation of 8-hydroxygeraniol to either 8-hydroxygeranial or 8-oxogeraniol followed by subsequent oxidation of either intermediate to 8-oxogeranial in the presence of the cofactor, nicotinamide adenine dinucleotide ($NAD^+$) or nicotinamide adenine dinucleotide phosphate ($NADP^+$) for each equivalent oxidation. See, e.g., SEQ ID NOs:1118-1156 (nucleotide sequences) and SEQ ID NOs:330-368 (amino acid sequences).

Set 7: One or more iridoid synthases (IS or ISY) capable of cyclization of 8-oxogeranial to nepetalactol; and/or one or more IS capable of carrying out this cyclization with reduced byproduct formation. Iridoid synthases catalyze the 1,4-reduction of 8-oxogeranial to form an enol intermediate in the presence of the cofactor reduced nicotinamide adenine dinucleotide (NADH) or reduced nicotinamide adenine dinucleotide phosphate (NADPH). See, e.g., SEQ ID NOs: 1157-1307, 1778-1807 (nucleotide sequences) and SEQ ID NOs:369-519, 1695-1724 (amino acid sequences). The enol intermediate can be cyclized to nepetalactol spontaneously, by the iridoid synthase, or by a newly discovered enzyme, nepetalactol synthase (NEPS), which is described in more detail below; e.g., SEQ ID NOs:1506-1562 (nucleotide sequences) and SEQ ID NOs:718-774 (amino acid sequences). In some embodiments, therefore, Set 7 can include one or more NEPS (which, in some embodiments, is used in addition to an IS). In other embodiments, the one of more NEPS are included in a separate set of enzymes.

Set 8: One or more nepetalactol oxidoreductases (NOR) capable of oxidation of nepetalactol to nepetalactone; e.g., SEQ ID NOs:1308-1395, 1563-1570, 1725-1727 (nucleotide sequences) and SEQ ID NOs:520-607, 775-782, 1642-1644 (amino acid sequences).

Set 9: One or more cytochrome B5 reductase (CYBSR); e.g., SEQ ID NOs: 1571-1576 (nucleotide sequences) and SEQ ID NOs:783-788 (amino acid sequences).

Set 10: One or more GPPS-GES fusion; e.g., SEQ ID NOs:1396-1397, 1728-1777 (nucleotide sequences) and SEQ ID NOs:608-609, 1645-1694 (amino acid sequences).

Set 11: One or more G8H-CPR fusion; e.g., SEQ ID NOs:1398-1462 (nucleotide sequences) and SEQ ID NOs: 610-674 (amino acid sequences).

Set 12: One or more G8H-CPR-CYB5 fusion; e.g., SEQ ID NOs:1463-1481 (nucleotide sequences) and SEQ ID NOs:675-693 (amino acid sequences).

Set 13: One or more 8HGO-ISY fusion; e.g., SEQ ID NOs:1482-1493 (nucleotide sequences) and SEQ ID NOs: 694-705 (amino acid sequences).

Set 14: One or more ISY-NEPS fusion; e.g., SEQ ID NOs:1494-1505 (nucleotide sequences) and SEQ ID NOs: 706-717 (amino acid sequences).

In various embodiments, the microbial host cell is engineered to express: (a) one or more enzymes from set 8 above (NORs); (b) one or more enzymes from sets 7 and 8; (c) one or more enzymes from sets 6-8; (c) one or more enzymes from sets 5-8; (d) one or more enzymes from sets 4-8; (e) one or more enzymes from sets 3-8; (f) one or more enzymes from sets 2-8; and/or (g) one or more enzymes from sets 1-8 (e.g., as was done in *Saccharomyces cerevisiae* in Example 2).

In some embodiments, a microbial host cell is engineered to express one or more non-native enzymes from or involved in a biosynthetic pathway for producing nepetalactone from precursor metabolites. In some embodiments, the biosynthetic pathway for producing nepetalactone from precursor metabolites comprises the pathway shown in FIG. 1. In a preferred embodiment, the microbial host cell is a non-plant cell. In some embodiments, the microbial host cell is engineered to express one or more enzymes from any one of sets 1-14 above. In some embodiments, the microbial host cell is engineered to express one or more enzymes from any one or more of sets 1-14 above.

In some embodiments, the microbial host cell is engineered to express one or more enzymes from set 8 above (NORs). In other embodiments, the microbial host cell is engineered to express one or more enzymes from set 8 above (NORs), and a nepetalactol synthase (NEPS) from set 7 above. In various embodiments, the microbial host cell is engineered to express a heterologous polypeptide comprising one or more enzymes from set 8 above (NORs) and one or more enzymes from set 7 above (ISY), excluding a NEPS enzyme. In other embodiments, the microbial host cell is engineered to express a heterologous polypeptide comprising one or more enzymes from set 8 above (NORs) and one or more enzymes from set 7 above (ISY), including one or more NEPS enzyme. In other embodiments, the microbial host cell is engineered to express a heterologous polypeptide comprising one or more enzymes from set 8 above (NORs), one or more enzymes from set 7 above (ISY), including one or more NEPS enzyme, and one or more enzymes from set 6 above (8HGO). In other embodiments, the microbial host cell is engineered to express a heterologous polypeptide comprising one or more enzymes from set 8 above (NORs), one or more enzymes from set 7 above (ISY), including one or more NEPS enzyme, one or more enzymes from set 6 above (8HGO), one or more enzymes from set 3 above (G8H). In other embodiments, the microbial host cell is engineered to express a heterologous polypeptide comprising one or more enzymes from set 8 above (NORs), one or more enzymes from set 7 above (ISY), including one or more NEPS enzyme, one or more enzymes from set 6 above (8HGO), one or more enzymes from set 3 above (G8H), one or more enzymes from set 5 above (CYB5). In other embodiments, the microbial host cell is engineered to express a heterologous polypeptide comprising one or more enzymes from set 8 above (NORs), one or more enzymes from set 7 above (ISY), including one or more NEPS enzyme, one or more enzymes from set 6 above (8HGO), one or more enzymes from set 3 above (G8H), one or more enzymes from set 5 above (CYB5), one or more enzymes from set 4 above (CPR). In some embodiments, the microbial host cell is engineered to express a heterologous polypeptide further comprising one or more enzymes from set 1 (GPPS) above and/or set 2 above (GES) in addition to the enzymes expressed in any one of the aforementioned embodiments. In yet other embodiments, the microbial host cell is engineered to express a heterologous polypeptide comprising an engineered polypeptide (e.g., ISY-NEPS). Such engineered (i.e., fused) polypeptides may be introduced instead of or in addition to a heterologous non-fused enzyme having a common activity. For example, the microbial host cell may be engineered to express a heterologous polypeptide comprising ISY-NEPS to introduce or supplement ISY and/or NEPS activity in the cell.

Illustrative sets of nucleotide sequences encoding these enzymes are provided in Example 2 and the Sequence Listing filed herewith. These polynucleotides including these sequences, or variants thereof, are useful for reconstituting the nepetalactone pathway in microbes. Because of the degeneracy of the genetic code, it is possible to substitute one or more nucleotide bases without changing the amino acid sequence of the encoded protein. Variants of these polynucleotides include, for example, those having sequences that are codon-optimized for expression in a particular host cell. In various embodiments, variants of these polynucleotides include sequences at least 60, 65, 70, 75, 80, 85, 90, 95, 96, 97, 98, or 99 percent sequence identity with one or more of the nucleotide sequences referenced in the Examples and Sequence Listing filed herewith.

Novel Polynucleotides Encoding Nepetalactone Oxidoreductases

Examples 1 and 6 describe the identification and isolation of polynucleotides that include a nucleotide sequence that encode an active nepetalactol oxidoreductase (NOR). The nucleotide sequences encoding tested and/or putative NORs are given in the accompanying Sequence Listing; e.g., SEQ ID NOs:1308-1395, 1563-1570, 1725-1727.

These polynucleotides, or variants thereof, are useful for producing NORs. Because of the degeneracy of the genetic code, it is possible to substitute one or more nucleotide bases without changing the amino acid sequence of the encoded protein. Variants of NOR polynucleotide sequences include, for example, those having sequences that are codon-optimized for expression in a particular host cell. In various embodiments, variants of the NOR polynucleotides have at least 60, 65, 70, 75, 80, 85, 90, 95, 96, 97, 98, or 99 percent sequence identity with one or more of SEQ ID NOs:1308-1395, 1563-1570, 1725-1727.

Novel Nepetalactone Oxidoreductase Polypeptides

The deduced amino acid sequences for these NOR polynucleotides are provided in the Sequence Listing; e.g., SEQ ID NOs:520-607, 775-782, 1642-1644. Examples 1 and 6 demonstrate the function of novel NORs to convert nepetalactol to nepetalactone in the presence of NAD+ or NADP+.

In certain embodiments, modifications of the NOR polypeptide sequences, such as conservative substitutions of amino acids, are contemplated. In various embodiments one, two, three, four, five or more different residues are substituted. The term "conservative substitution" is used to reflect amino acid substitutions that do not substantially diminish the activity of the molecule. Typically, conservative amino acid substitutions involve substitution of one amino acid for another amino acid with similar chemical properties (e.g., charge or hydrophobicity). The following six illustrative, but non-limiting, groups each contain amino acids that are typical conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K), Histidine (H); 5) Isoleucine (I), Leucine (L), Methionine (M), Valine (V); and 6) Phenylalanine (F), Tyrosine (Y), Tryptophan (W).

In various embodiments, the active NOR has an amino acid sequence that has more than 75, 80, 85, 90, 91, 92, 93, 94, 95, 96, 97, 98, or 99 percent sequence identity with SEQ ID NOs:520-607, 775-782, 1642-1644.

Novel Polynucleotides Encoding Nepetalactol Synthases

Examples 4 describes the identification and isolation of polynucleotides that include a nucleotide sequence that encode an active nepetalactol synthase (NEPS). The nucleotide sequences encoding tested and/or putative NEPSs are given in the accompanying Sequence Listing; e.g., SEQ ID NOs:1506-1562.

These polynucleotides, or variants thereof, are useful for producing NEPSs. Because of the degeneracy of the genetic code, it is possible to substitute one or more nucleotide bases without changing the amino acid sequence of the encoded protein. Variants of NEPS polynucleotide sequences include, for example, those having sequences that are codon-optimized for expression in a particular host cell. In various embodiments, variants of the NEPS polynucleotides have at least 60, 65, 70, 75, 80, 85, 90, 95, 96, 97, 98, or 99 percent sequence identity with one or more of the nucleotide sequences given in the Sequence Listing, e.g., SEQ ID NOs:1506-1562.

Novel Nepetalactol Synthase Polypeptides

Figure 5:
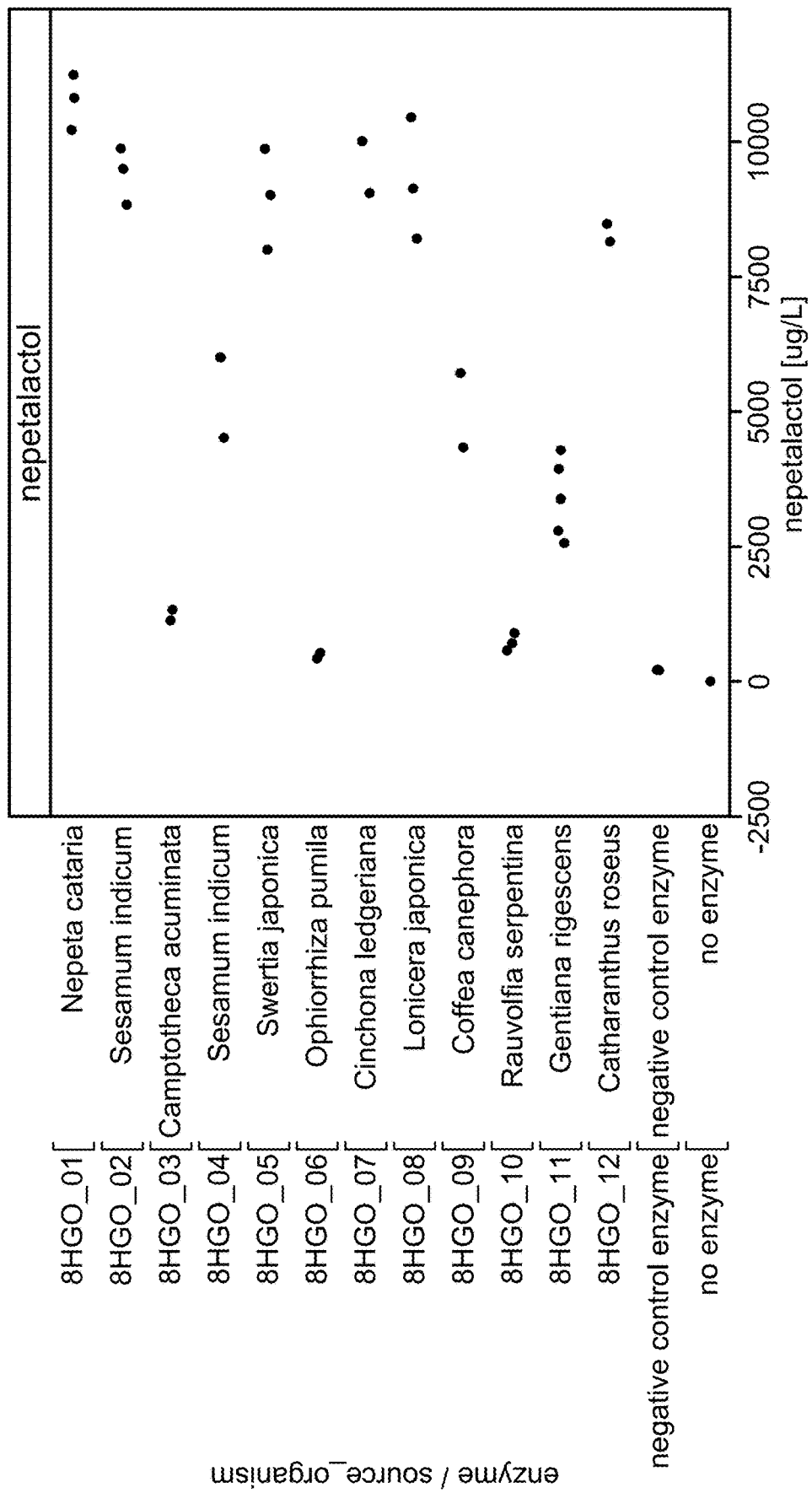
FIG. 5: In vitro conversion of 8-hydroxygeraniol to nepetalactol by 8HGOs coupled to Nepeta mussinii iridoid synthase (ISY) and C. roseus nepetalactol synthase (NEPS_1) in the presence of NAD$^+$ and NADPH. The nepetalactol produced is (4αS,7S,7αR)-nepetalactol, as determined by liquid chromatography-mass spectrometry (no other stereoisomsers were detected by this method).

The deduced amino acid sequences for these NEPSs are also provided in the Sequence Listing (SEQ ID NOs:718-774). Example 4 demonstrates the function of novel NEPS to convert 8-oxogeranial to nepetalactol in the presence of iridoid synthase (ISY) and NADPH (see FIG. 5). In various embodiments, the presence of a NEPS increases nepetalactol production by at least 5-fold, 10-fold, 15-fold, 20-fold, 25-fold, 30-fold, 35-fold, 40-fold, 45-fold, or 50-fold, or more. In some embodiments the increase in nepetalactol production is less than 100-fold, 75-fold, or 50-fold. In particular embodiments, the increase in nepetalactol production falls within a range bounded by any of these values, such as, e.g., 5-fold to 50-fold or 10-fold to 40-fold.

In certain embodiments, modifications of the NEPS polypeptide sequences, such as conservative substitutions of amino acids, are contemplated. In various embodiments one, two, three, four, five or more different residues are substituted. The term "conservative substitution" is used to reflect amino acid substitutions that do not substantially diminish the activity of the molecule. Typically, conservative amino acid substitutions involve substitution of one amino acid for another amino acid with similar chemical properties (e.g., charge or hydrophobicity). The following six illustrative, but non-limiting, groups each contain amino acids that are typical conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K), Histidine (H); 5) Isoleucine (I), Leucine (L), Methionine (M), Valine (V); and 6) Phenylalanine (F), Tyrosine (Y), Tryptophan (W).

In various embodiments, the polynucleotide encodes an active NEPS comprising an amino acid sequence that has more than 75, 80, 85, 90, 91, 92, 93, 94, 95, 96, 97, 98, or 99 percent sequence identity with sequences given in the Sequence Listing, e.g., SEQ ID NOs: 718-774.

Novel Pathway for Biosynthetic Conversion of 8-Hydroxygeranial to Nepetalactol

In some embodiments, enzymes for biosynthetic conversion of the native precursor metabolites, dimethylallyl pyrophosphate (DMAPP) and isopentenyl pyrophosphate (IPP) to nepetalactol and, optionally, nepetalactone are used in nepetalactol/neptalactone production. The pathway for producing nepetalactol from the native precursor metabolites, dimethylallyl pyrophosphate (DMAPP) and isopentenyl pyrophosphate (IPP) is shown in FIG. 1. The enzymes to be introduced to reconstitute the nepetalactone pathway in a host cell (e.g., a microbial host cell) depend on the enzymes native to that host cell. These can include one or more of the following enzymes:

- any 8-hydroxygeraniol oxidoreductase (8HGO; also termed hydroxygeraniol oxidases [10HGO], as well as hydroxygeraniol dehydrogenases) described herein, or fusion thereof;
- any iridoid synthase (IS or ISY) described herein, or fusion thereof;
- any nepetalactol synthase (NEPS) described herein, or fusion thereof;
- any nepetalactone oxidoreductase (NOR) described herein, or fusion thereof;
- any geraniol diphosphate synthases (GPPS) described herein, or fusion thereof;
- any geraniol synthases (GES) described herein, or fusion thereof;
- any geraniol hydroxylases (G8H or G10H) described herein, or fusion thereof;
- any cytochrome P450 reductases (CPR) described herein, or fusion thereof;
- any cytochrome B5 (CYB5 or CytB5) described herein, or fusion thereof;
- any cytochrome B5 reductase (CYBSR or CYBR) described herein, or fusion thereof;
- any GPPS-GES fusion, described herein, or further fusion thereof;
- any G8H-CPR fusion, described herein, or further fusion thereof;
- any G8H-CPR-CYB5 fusion, described herein, or further fusion thereof;
- any 8HGO-ISY fusion, described herein, or further fusion thereof; and/or
- any ISY-NEPS fusion, described herein, or further fusion thereof.

These enzymes allow the biosynthesis of nepetalactol or nepetalactone in a host cell (e.g., a microbial host cell) when one or more of the above enzymes (e.g., 8HGO, ISY, NEPs, NORs) are co-expressed with the remaining known enzymes required for nepetalactol or nepetalactone formation, respectively. A host cell expressing one or more of the above enzymes may be provided with glucose and/or an intermediate in the pathway (e.g., 8-hydroxygeraniol and/or geraniol) to generate nepetalactol or nepetalactone in the cell. These enzymes can also be used in chemoenzymatic processes where 8-hydroxygeraniol and/or geraniol and the aforementioned cofactors are added to an enzyme preparation containing one or more of each of the enzymes. These enzymes can be obtained, e.g., by heterologous expression in a host cell, followed by cell lysis and optional protein purification steps, or by cell-free expression, followed by optional protein purification steps. Illustrative nucleotide and amino acid sequences for these enzymes, in addition to sequences discussed above with respect to the full pathway for producing nepetalactone, are found in the Sequence Listing (SEQ ID NOs:1-788, 1642-1724).

Engineering Host Cells to Express a Nepetalactone Pathway Enzyme

The polynucleotides described herein can be modified by adding a nucleotide sequence that is not naturally linked to the polynucleotide to form a chimeric polynucleotide. For example, a polynucleotide encoding a nepetalactone pathway enzyme (NPE) can be linked to a promoter, a ribosome binding sequence (RBS) and a downstream terminator sequence to produce an expression construct that can be introduced into a vector, as illustrated in the Examples. In many cases, the vector provides sequences that facilitate expression in a host cell.

Vectors

Vectors are polynucleotide vehicles used to introduce genetic material into a cell. Vectors useful in the methods described herein can be linear or circular. Vectors can integrate into a target genome of a host cell or replicate independently in a host cell. For many applications, integrating vectors that produced stable transformants are preferred. Vectors can include, for example, an origin of replication, a multiple cloning site (MCS), and/or a selectable marker. An expression vector typically includes an expression cassette containing regulatory elements that facilitate expression of a polynucleotide sequence (often a coding sequence) in a particular host cell. Vectors include, but are not limited to, integrating vectors, prokaryotic plasmids, episomes, viral vectors, cosmids, and artificial chromosomes.

Illustrative regulatory elements that may be used in expression cassettes include promoters, enhancers, internal ribosomal entry sites (IRES), and other expression control elements (e.g., transcription termination signals, such as polyadenylation signals and poly-U sequences). Such regulatory elements are described, for example, in Goeddel, Gene Expression Technology: Methods In Enzymology 185, Academic Press, San Diego, Calif. (1990).

Host Cells

Any host cell that can be used to express introduced genes can be engineered to express any of the NPEs described herein. In some embodiments, the host cell is a non-plant cell. Suitable host cells include microbial cells. In certain embodiments, the microbe is one that is naturally incapable of fermentative production of nepetalactone. In particular embodiments, the microbe is one that is naturally capable of producing nepetalactol, or one that has been engineered to produce nepetalactol, as described herein. In some embodiments, the microbe is one that is readily cultured, such as, for example, a microbe known to be useful as a host cell in fermentative production of compounds of interest. Bacteria cells, including gram positive or gram negative bacteria can be engineered as described herein. Examples include, in addition to *C. glutamicum* cells, *Bacillus subtilus, B. licheniformis, B. lentus, B. brevis, B. stearothermophilus, B. alkalophilus, B. amyloliquefaciens, B. clausii, B. halodurans, B. megaterium, B. coagulans, B. circulans, B. lautus, B. thuringiensis, S. albus, S. lividans, S. coelicolor, S. griseus, Pseudomonas* sp., *P. alcaligenes, P. citrea, Lactobacilis* spp. (such as *L. lactis, L. plantarum*), *L. grayi, E. coli, E. faecium, E. gallinarum, E. casseliflavus*, and/or *E. faecalis* cells.

There are numerous types of anaerobic cells that can be used as microbial host cells in the methods described herein. In some embodiments, the microbial cells are obligate anaerobic cells. Obligate anaerobes typically do not grow well, if at all, in conditions where oxygen is present. It is to be understood that a small amount of oxygen may be present, that is, there is some level of tolerance that obligate anaerobes have for a low level of oxygen. Obligate anaerobes engineered as described herein can be grown under substantially oxygen-free conditions, wherein the amount of oxygen present is not harmful to the growth, maintenance, and/or fermentation of the anaerobes.

Alternatively, the microbial host cells used in the methods described herein can be facultative anaerobic cells. Facultative anaerobes can generate cellular ATP by aerobic respiration (e.g., utilization of the TCA cycle) if oxygen is present. However, facultative anaerobes can also grow in the absence of oxygen. Facultative anaerobes engineered as described herein can be grown under substantially oxygen-free conditions, wherein the amount of oxygen present is not harmful to the growth, maintenance, and/or fermentation of the anaerobes, or can be alternatively grown in the presence of greater amounts of oxygen.

In some embodiments, the microbial host cells used in the methods described herein are filamentous fungal cells. (See, e.g., Berka & Barnett, Biotechnology Advances, (1989), 7(2):127-154). Examples include *Trichoderma longibrachiatum, T. viride, T. koningii, T. harzianum, Penicillium* sp., *Humicola insolens, H. lanuginose, H. grisea, Chrysosporium* sp., *C. lucknowense, Gliocladium* sp., *Aspergillus* sp. (such as *A. oryzae, A. niger, A. sojae, A. japonicus, A. nidulans*, or *A. awamori*), *Fusarium* sp. (such as *F. roseum, F. graminum F. cerealis, F. oxysporuim*, or *F. venenatum*), *Neurospora* sp. (such as *N. crassa* or *Hypocrea* sp.), *Mucor* sp. (such as *M. miehei*), *Rhizopus* sp., and *Emericella* sp. cells. In particular embodiments, the fungal cell engineered as described herein is *A. nidulans, A. awamori, A. oryzae, A. aculeatus, A. niger, A. japonicus, T. reesei, T. viride, F. oxysporum*, or *F. solani*. Illustrative plasmids or plasmid components for use with such hosts include those described in U.S. Patent Pub. No. 2011/0045563.

Yeasts can also be used as the microbial host cell in the methods described herein. Examples include: *Saccharomyces* sp., *Schizosaccharomyces* sp., *Pichia* sp., *Hansenula polymorpha, Pichia stipites, Kluyveromyces marxianus, Kluyveromyces* spp., *Yarrowia lipolytica* and *Candida* sp. In some embodiments, the *Saccharomyces* sp. is *S. cerevisiae* (See, e.g., Romanos et al., Yeast, (1992), 8(6):423-488). Illustrative plasmids or plasmid components for use with such hosts include those described in U.S. Pat. No. 7,659,097 and U.S. Patent Pub. No. 2011/0045563.

In other embodiments, the host cell can be an algal cell derived, e.g., from a green algae, red algae, a glaucophyte, a chlorarachniophyte, a euglenid, a chromista, or a dinoflagellate. (See, e.g., Saunders & Warmbrodt, "Gene Expression in Algae and Fungi, Including Yeast," (1993), National Agricultural Library, Beltsville, Md.). Illustrative plasmids or plasmid components for use in algal cells include those described in U.S. Patent Pub. No. 2011/0045563.

In other embodiments, the host cell is a cyanobacterium, such as cyanobacterium classified into any of the following groups based on morphology: *Chlorococcales, Pleurocapsales, Oscillatoriales, Nostocales, Synechosystic* or *Stigonematales* (See, e.g., Lindberg et al., Metab. Eng., (2010) 12(1):70-79). Illustrative plasmids or plasmid components for use in cyanobacterial cells include those described in U.S. Patent Pub. Nos. 2010/0297749 and 2009/0282545 and in Intl. Pat. Pub. No. WO 2011/034863.

Genetic Engineering Methods

Microbial cells can be engineered to express any of the NPEs described herein and, optionally, for fermentative nepetalactone production using conventional techniques of molecular biology (including recombinant techniques), microbiology, cell biology, and biochemistry, which are within the skill of the art. Such techniques are explained fully in the literature, see e.g., "Molecular Cloning: A Laboratory Manual," fourth edition (Sambrook et al., 2012); "Oligonucleotide Synthesis" (M. J. Gait, ed., 1984); "Culture of Animal Cells: A Manual of Basic Technique and Specialized Applications" (R. I. Freshney, ed., 6th Edition, 2010); "Methods in Enzymology" (Academic Press, Inc.); "Current Protocols in Molecular Biology" (F. M. Ausubel et al., eds., 1987, and periodic updates); "PCR: The Polymerase Chain Reaction," (Mullis et al., eds., 1994); Singleton et al., Dictionary of Microbiology and Molecular Biology 2nd ed., J. Wiley & Sons (New York, N.Y. 1994).

Vectors or other polynucleotides can be introduced into microbial cells by any of a variety of standard methods, such as transformation, conjugation, electroporation, nuclear microinjection, transduction, transfection (e.g., lipofection mediated or DEAE-Dextrin mediated transfection or transfection using a recombinant phage virus), incubation with calcium phosphate DNA precipitate, high velocity bombardment with DNA-coated microprojectiles, and protoplast fusion. Transformants can be selected by any method known in the art. Suitable methods for selecting transformants are described in U.S. Patent Pub. Nos. 2009/0203102, 2010/0048964, and 2010/0003716, and International Publication Nos. WO 2009/076676, WO 2010/003007, and WO 2009/132220.

Examples 1-3, 6 describes an illustrative approach for identifying and expressing NORs and NEPS in *E. coli* and *Saccharomyces cerevisiae* cells.

Cells Engineered to Express Nepetalactone Pathway Enzymes

The above-described methods can be used to produce engineered host cells that express one or more heterologous NPEs, such as those described herein. In a preferred embodiment, the engineered host cell is a non-plant cell. In some embodiments, a NOR is expressed and then used to convert nepetalactol to nepetalactone. In this case, the engineered host cells need not produce nepetalactol, which can be separately provided to the expressed NOR (e.g., in the culture medium, cell lysate, or purified), along with NAD+ and/or NADP+.

In other embodiments, the engineered host cell produces, and in certain embodiments, overproduces, nepetalactone. In some embodiments, non-plant cells are engineered to produce or overproduce nepetalactone. In particular embodiments, the non-plant cells are microbial cells, and for ease of discussion, the following description focuses on microbial cells (although those of skill in the art readily appreciate that the following considerations apply to non-microbial cells, as well). In some embodiments, the microbial cell is one that produces isopentyl diphosphate (IPP) and dimethylallyl diphosphate (DMAPP). Such a cell can be engineered to produce nepetalactone by expressing any of the following enzymes that are not native to the microbial cell: a geraniol diphosphate synthase (GPPS), a geranyl diphosphate diphosphatase (geraniol synthase (GES)), a geraniol 8-hydroxylase (G8H), a cytochrome P450 reductase (CPR) capable of promoting regeneration of the redox state of the G8H, a cytochrome B5 (CYB5) capable of promoting regeneration of the redox state of the G8H, 8-hydroxygeraniol dehydrogenase (8HGO), an iridoid synthase (ISY), and/or a NOR, e.g., as described above in the section entitled "Novel Pathway for Microbial Production of Nepetalactone" (see also co-owned International Application No. PCT/US18/64351, entitled "Engineered Biosynthetic Pathways for Production of (6E)-8-Hydroxygeraniol By Fermentation," which is incorporated by reference in its entirety and specifically for its description of genetic engineering of the iridoid synthetic pathway to produce (6E)-8-hydroxygeraniol).

Engineered microbial cells can have 1, 2, 3, 4, 5, 6, 7, 8, 9, 10, 11, 12, 13, 14, 15, 16, 17, 18, 19, 20 or more genetic alterations, as compared to a native microbial cell, such as any of the microbial host cells described herein. Those of skill in the art can, following the guidance set forth herein, can design microbial cells with additional alterations. Additional genetic alterations can be introduced to increase nepetalactone production by, for example, increasing the activity of upstream enzymes in the biosynthetic pathway leading to nepetalactone, reducing the consumption of precursor compounds (e.g., by "side-pathways" leading to products other than nepetalactone), or by reducing feedback inhibition. In some embodiments, the engineered microbial cells have not more than 15, 14, 13, 12, 11, 10, 9, 8, 7, 6, 5, or 4 genetic alterations, as compared to a native microbial cell. In various embodiments, microbial cells engineered for nepetalactone production can have a number of genetic alterations falling within the any of the following illustrative ranges: 1-20, 2-19, 3-18, 4-17, 5-16, 6-15, 7-14, 7-13, 7-12, or 7-11, etc.

In some embodiments, the methods and/or engineered microbes described herein are capable of producing nepetalactone and/or nepetalactol at a level of at least about: 0.01 g/L, 0.02 g/L, 0.03 g/L, 0.04 g/L, 0.05 g/L, 0.06 g/L, 0.07 g/L, 0.08 g/L, 0.09 g/L, 0.10 g/L, 0.20 g/L, 0.30 g/L, 0.40 g/L, 0.50 g/L, 0.60 g/L, 0.70 g/L, 0.80 g/L, 0.90 g/L, 1.00 g/L, 2.00 g/L, 3.00 g/L, 4.00 g/L, 5.00 g/L, 6.00 g/L, 7.00 g/L, 8.00 g/L, 9.00 g/L, 10.00 g/L, 20.00 g/L, 30.00 g/L, 40.00 g/L, or 50.00 g/L of cell lysate or culture medium. In some embodiments, the methods and/or engineered microbes described herein are capable of producing nepetalactone and/or nepetalactol at a level of at most about: 0.01 g/L, 0.02 g/L, 0.03 g/L, 0.04 g/L, 0.05 g/L, 0.06 g/L, 0.07 g/L, 0.08 g/L, 0.09 g/L, 0.10 g/L, 0.20 g/L, 0.30 g/L, 0.40 g/L, 0.50 g/L, 0.60 g/L, 0.70 g/L, 0.80 g/L, 0.90 g/L, 1.00 g/L, 2.00 g/L, 3.00 g/L, 4.00 g/L, 5.00 g/L, 6.00 g/L, 7.00 g/L, 8.00 g/L, 9.00 g/L, 10.00 g/L, 20.00 g/L, 30.00 g/L, 40.00 g/L, or 50.00 g/L of cell lysate or culture medium. In some embodiments, the methods and/or engineered microbes described herein are capable of producing nepetalactone and/or nepetalactol at a level between about: 0.01-50.00 g/L, 0.05-40.00 g/L, 0.10-30.00 g/L, 0.15-20.00 g/L, 0.20-10.00 g/L, 0.30-10.00 g/L, 0.40-10.00 g/L, 0.50-10.00 g/L, 0.60-10.00 g/L, 0.70-10.00 g/L, 0.80-10.00 g/L, 0.90-10.00 g/L, 1.00-10.00 g/L, 2.00-10.00 g/L, 3.00-10.00 g/L, 4.00-10.00 g/L, 5.00-10.00 g/L, 0.20-5.00 g/L, 0.30-5.00 g/L, 0.40-5.00 g/L, 0.50-5.00 g/L, 0.60-5.00 g/L, 0.70-5.00 g/L, 0.80-5.00 g/L, 0.90-5.00 g/L, 1.00-5.00 g/L, 2.00-5.00 g/L, 3.00-5.00 g/L, 0.20-3.00 g/L, 0.30-3.00 g/L, 0.40-3.00 g/L, 0.50-3.00 g/L, 0.60-3.00 g/L, 0.70-3.00 g/L, 0.80-3.00 g/L, 0.90-3.00 g/L, 1.00-3.00 g/L, 2.00-3.00 g/L, 0.20-2.00 g/L, 0.30-2.00 g/L, 0.40-2.00 g/L, 0.50-2.00 g/L, 0.60-2.00 g/L, 0.70-2.00 g/L, 0.80-2.00 g/L, 0.90-2.00 g/L, or 1.00-2.00 g/L of cell lysate or culture medium.

In various embodiments, expression of a NOR in an engineered microbial cell enables the production of nepetalactone (in the presence of nepetalactol and NAD+ and/or NADP+) at a level of at least 10, 20, 30, 40, 50, 60, 70, 80, 90, 100, 200, 300, 400, 500, 600, 700, 800, or 900 µM of cell lysate or culture medium (e.g., if the NOR is secreted), or at least 1, 10, 50, 75, 100, 200, 300, 400, 500, 600, 700, 800, or 900 mM of cell lysate or culture medium or at least 1, 1.5, 2, 2.5, 3, 3.5, 4, 4.5, 5, or 10 M of cell lysate or culture medium. (50 µM nepetalactone equates to 8.31 mg/L). In various embodiments, the level is in the range of 10 µM to 10 M, 25 µM to 5 M, 50 µM to 4 M, 75 µM to 3 M, 100 µM to 2 M or any range bounded by any of the values listed above.

Culturing of Engineered Microbial Cells

Any of the microbial cells described herein can be cultured, e.g., for maintenance, growth, and/or nepetalactone production.

In some embodiments, the cultures are grown to an optical density at 600 nm of 10-500, such as an optical density of 50-150. In a preferred embodiment, the optical density is measured without concentrating cells In various embodiments, the cultures include nepetalactone at a level of at least 10, 20, 30, 40, 50, 60, 70, 80, 90, 100, 200, 300, 400, 500, 600, 700, 800, or 900 µM of culture medium (if the NOR is secreted and if the culture includes nepetalactol and NAD+ or NADP+), or at least 1, 10, 50, 75, 100, 200, 300, 400, 500, 600, 700, 800, or 900 mM of culture medium or at least 1, 1.5, 2, 2.5, 3, 3.5, 4, 4.5, 5, or 10 M of culture medium. In various embodiments, the level is in the range of 10 µM to 10 M, 25 µM to 5 M, 50 µM to 4 M, 75 µM to 3 M, 100 µM to 2 M or any range bounded by any of the values listed above.

Culture Media

Microbial (as well as other) cells can be cultured in any suitable medium including, but not limited to, a minimal medium, i.e., one containing the minimum nutrients possible for cell growth. Minimal medium typically contains: (1) a carbon source for microbial growth; (2) salts, which may depend on the particular microbial cell and growing conditions; and (3) water. Suitable media can also include any combination of the following: a nitrogen source for growth and product formation, a sulfur source for growth, a phosphate source for growth, metal salts for growth, vitamins for growth, and other cofactors for growth.

Any suitable carbon source can be used to cultivate the host cells. The term "carbon source" refers to one or more carbon-containing compounds capable of being metabolized by a microbial cell. In various embodiments, the carbon source is a carbohydrate (such as a monosaccharide, a disaccharide, an oligosaccharide, or a polysaccharide), or an invert sugar (e.g., enzymatically treated sucrose syrup). Illustrative monosaccharides include glucose (dextrose), fructose (levulose), and galactose; illustrative oligosaccharides include dextran or glucan, and illustrative polysaccharides include starch and cellulose. Suitable sugars include C6 sugars (e.g., fructose, mannose, galactose, or glucose) and C5 sugars (e.g., xylose or arabinose). Other, less expensive carbon sources include sugar cane juice, beet juice, sorghum juice, and the like, any of which may, but need not be, fully or partially deionized.

The salts in a culture medium generally provide essential elements, such as magnesium, nitrogen, phosphorus, and sulfur to allow the cells to synthesize proteins and nucleic acids.

Minimal medium can be supplemented with one or more selective agents, such as antibiotics.

To produce nepetalactone, the culture medium can include, and/or is supplemented during culture with, glucose and/or a nitrogen source such as urea, an ammonium salt, ammonia, or any combination thereof. In some embodiments, the culture medium includes and/or is supplemented to include any carbon source of the nepetalactone biosynthetic pathway, for example, as shown in FIG. 1. In some embodiments, the culture medium includes and/or is supplemented to include geraniol and/or 8-hydroxygeraniol. In some embodiments, the culture medium includes and/or is supplemented to include any carbon source of the nepetalactone biosynthetic pathway in the range of about 0.1-100 g/L.

Culture Conditions

Materials and methods suitable for the maintenance and growth of microbial (and other) cells are well known in the art. See, for example, U.S. Pub. Nos. 2009/0203102, 2010/0003716, and 2010/0048964, and International Pub. Nos. WO 2004/033646, WO 2009/076676, WO 2009/132220, and WO 2010/003007, Manual of Methods for General Bacteriology Gerhardt et al., eds), American Society for Microbiology, Washington, D.C. (1994) or Brock in Biotechnology: A Textbook of Industrial Microbiology, Second Edition (1989) Sinauer Associates, Inc., Sunderland, Mass.

In general, cells are grown and maintained at an appropriate temperature, gas mixture, and pH (such as about 20° C. to about 37° C., about 6% to about 84% $CO_2$, and a pH between about 5 to about 9). In some aspects, cells are grown at 35° C. In certain embodiments, such as where thermophilic bacteria are used as the host cells, higher temperatures (e.g., 50° C.-75° C.) may be used. In some aspects, the pH ranges for fermentation are between about pH 5.0 to about pH 9.0 (such as about pH 6.0 to about pH 8.0 or about 6.5 to about 7.0). Cells can be grown under aerobic, anoxic, or anaerobic conditions based on the requirements of the particular cell.

Standard culture conditions and modes of fermentation, such as batch, fed-batch, or continuous fermentation that can be used are described in U.S. Publ. Nos. 2009/0203102, 2010/0003716, and 2010/0048964, and International Pub. Nos. WO 2009/076676, WO 2009/132220, and WO 2010/003007. Batch and Fed-Batch fermentations are common and well known in the art, and examples can be found in Brock, Biotechnology: A Textbook of Industrial Microbiology, Second Edition (1989) Sinauer Associates, Inc.

In some embodiments, the cells are cultured under limited sugar (e.g., glucose) conditions. In various embodiments, the amount of sugar that is added is less than or about 105% (such as about 100%, 90%, 80%, 70%, 60%, 50%, 40%, 30%, 20%, or 10%) of the amount of sugar that can be consumed by the cells. In particular embodiments, the amount of sugar that is added to the culture medium is approximately the same as the amount of sugar that is consumed by the cells during a specific period of time. In some embodiments, the rate of cell growth is controlled by limiting the amount of added sugar such that the cells grow at the rate that can be supported by the amount of sugar in the cell medium. In some embodiments, sugar does not accumulate during the time the cells are cultured. In various embodiments, the cells are cultured under limited sugar conditions for times greater than or about 1, 2, 3, 5, 10, 15, 20, 25, 30, 35, 40, 50, 60, or 70 hours or even up to about 5-10 days. In various embodiments, the cells are cultured under limited sugar conditions for greater than or about 5, 10, 15, 20, 25, 30, 35, 40, 50, 60, 70, 80, 90, 95, or 100% of the total length of time the cells are cultured. While not intending to be bound by any particular theory, it is believed that limited sugar conditions can allow more favorable regulation of the cells.

In some aspects, the cells are grown in batch culture. The cells can also be grown in fed-batch culture or in continuous culture. Additionally, the cells can be cultured in minimal medium, including, but not limited to, any of the minimal media described above. The minimal medium can be further supplemented with 1.0% (w/v) glucose (or any other six-carbon sugar) or less. Specifically, the minimal medium can be supplemented with 1% (w/v), 0.9% (w/v), 0.8% (w/v), 0.7% (w/v), 0.6% (w/v), 0.5% (w/v), 0.4% (w/v), 0.3% (w/v), 0.2% (w/v), or 0.1% (w/v) glucose. In some cultures, significantly higher levels of sugar (e.g., glucose) are used, e.g., at least 10% (w/v), 20% (w/v), 30% (w/v), 40% (w/v), 50% (w/v), 60% (w/v), 70% (w/v), or up to the solubility limit for the sugar in the medium. In some embodiments, the sugar levels fall within a range of any two of the above values, e.g.: 0.1-10% (w/v), 1.0-20% (w/v), 10-70% (w/v), 20-60% (w/v), or 30-50% (w/v). Furthermore, different sugar levels can be used for different phases of culturing. For fed-batch culture (e.g., of *E. coli, S. cerevisiae* or *C. glutamicum*), the sugar level can be about 100-200 g/L (10-20% (w/v)) in the batch phase and then up to about 500-700 g/L (50-70% in the feed).

Additionally, the minimal medium can be supplemented with 0.1% (w/v) or less yeast extract. Specifically, the minimal medium can be supplemented with 0.1% (w/v), 0.09% (w/v), 0.08% (w/v), 0.07% (w/v), 0.06% (w/v), 0.05% (w/v), 0.04% (w/v), 0.03% (w/v), 0.02% (w/v), or 0.01% (w/v) yeast extract. Alternatively, the minimal medium can be supplemented with 1% (w/v), 0.9% (w/v), 0.8% (w/v), 0.7% (w/v), 0.6% (w/v), 0.5% (w/v), 0.4% (w/v), 0.3% (w/v), 0.2% (w/v), or 0.1% (w/v) glucose and with 0.1% (w/v), 0.09% (w/v), 0.08% (w/v), 0.07% (w/v), 0.06% (w/v), 0.05% (w/v), 0.04% (w/v), 0.03% (w/v), or 0.02% (w/v) yeast extract. In some cultures, significantly higher levels of yeast extract can be used, e.g., at least 1.5% (w/v), 2.0% (w/v), 2.5% (w/v), or 3% (w/v). In some cultures (e.g., of *E. coli, S. cerevisiae* or *C. glutamicum*), the yeast extract level falls within a range of any two of the above values, e.g.: 0.5-3.0% (w/v), 1.0-2.5% (w/v), or 1.5-2.0% (w/v).

Illustrative materials and methods suitable for the maintenance and growth of the engineered microbial cells described herein can be found below in Examples 1 and 2.

Cell-Based Production and Recovery of Nepetalactol or Nepetalactone and Enzymes of the Nepetalactone Biosynthetic Pathway Any of the methods described herein may further include a step of recovering an enzyme of the nepetalactone biosynthetic pathway as described herein (e.g., NOR) or, in cultures that produce it, recovering nepetalactone. In some embodiments, an upstream product of the nepetalactone biosynthetic pathway is recovered, for example nepetalactol. In some embodiments, where an enzyme of the nepetalactone biosynthetic pathway (e.g., NOR) or nepetalactone are produced intracellularly and not secreted, cells are recovered and a cell lysate is produced that contains an enzyme of the nepetalactone biosynthetic pathway (e.g., NOR) or nepetalactone. In some embodiments, where an enzyme of the nepetalactone biosynthetic pathway (e.g., NOR) is secreted and the nepetalactone is produced outside of the cells, an enzyme of the nepetalactone biosynthetic pathway (e.g., NOR) and/or nepetalactone is recovered. In some embodiments, where an enzyme of the nepetalactone biosynthetic pathway (e.g., NOR) and nepetalactone are produced intracellularly, and the nepetalactone is secreted, the nepetalactone is recovered.

In any case, a so-called harvest stream can be recovered/harvested from the production vessel. The harvest stream may include, for instance, cell-containing or cell-free aqueous solution coming from the production vessel. In some embodiments, the latter contains secreted nepetalactone oxidoreductase and nepetalactone as a result of the conversion of nepetalactol to nepetalactone in culture medium. Any residual cells still present in the harvest stream may be separated from the nepelatactol oxidoreductase and nepetalactone by any operations known in the art, such as for instance filtration, centrifugation, decantation, membrane crossflow ultrafiltration or microfiltration, tangential flow ultrafiltration or microfiltration or dead-end filtration.

In some embodiments, a mixture of stereoisomers of nepelatactol and/or nepetalactone is produced or recovered. In some embodiments, a single stereoisomer of nepetalactol and/or nepetalactone is produced or recovered. In some embodiments, cis,trans-nepelatactol, trans,cis-nepelatactol, trans,trans-nepelatactol, and/or cis,cis-nepelatactol is produced and/or recovered. In some embodiments, cis,trans-nepelatactone, trans,cis-nepetalactone, trans,trans-nepetalactone, and/or cis,cis-nepetalactone is produced and/or recovered.

Further steps of separation and/or purification of the enzyme of an nepetalactone biosynthetic pathway as described herein (e.g., NOR) or, in cultures that produce it, nepetalactone, from other components contained in the harvest stream, i.e., so-called downstream processing steps may optionally be carried out. These steps may include any means known to a skilled person, such as, for instance, concentration, extraction, crystallization, precipitation, adsorption, ion exchange, chromatography and/or distillation. Any of these procedures can be used alone or in combination to purify nepetalactone. Further purification steps can include one or more of, e.g., concentration, crystallization, precipitation, washing and drying, treatment with activated carbon, ion exchange and/or re-crystallization. The design of a suitable purification protocol may depend on the cells, the culture medium, the size of the culture, the production vessel, etc. and is within the level of skill in the art.

Cell-Free Production and Recovery of Nepetalactol or Nepetalactone and Enzymes of the Nepetalactone Biosynthetic Pathway In some embodiments, cell-free protein synthesis (CFPS) is carried out to produce/recover an enzyme of the nepetalactone biosynthetic pathway as described herein (e.g., a NOR) or, in cultures that produce it, nepetalactone. In some embodiments, an upstream product of the nepetalactone biosynthetic pathway is produced/recovered, for example nepetalactol. In some embodiments, a mixture of stereoisomers of nepelatactol and/or nepetalactone is produced or recovered. In some embodiments, a single stereoisomer of nepelatactol and/or nepetalactone is produced or recovered. In some embodiments, cis,trans-nepelatactol is produced and/or recovered. In some embodiments, cis,trans-nepetalactone is produced and/or recovered.

CFPS techniques are well known (see Carlson, E. D., et al. (2012), "Cell-free protein synthesis: applications come of age," Biotechnol. Adv. 30 (5): 1185-94, which is incorporated by reference herein for its description of CFPS). Common components of a CFPS reaction include a cell extract, an energy source, a supply of amino acids, cofactors such as magnesium, and the DNA with the desired gene. A cell extract can be obtained by lysing the cell of interest and centrifuging to remove the cell walls, genomic DNA, and other cellular debris. The resulting cell extract contains the cellular machinery necessary for protein synthesis, including ribosomes, aminoacyl-tRNA synthetases, translation initiation and elongation factors, nucleases, etc.

Cell extracts in use today are typically made from *E. coli* (ECE), rabbit reticulocytes (RRL), wheat germ (WGE), and insect cells (ICE). All of these extracts are commercially available. Generally, the energy source and amino acids are added to the extract. Common energy sources are phosphoenol pyruvate, acetyl phosphate, and creatine phosphate.

At least two types of DNA can be used in CFPS: plasmids and linear expression templates (LETs). Plasmids must be propagated inside cells. Multiple copies of LETs can be made much more effectively via nucleic acid amplification (e.g., PCR), which replicates DNA much faster than raising cells in an incubator. While LETs are easier and faster to produce, yields from plasmids are usually much higher in CFPS.

Methods of Oxidizing Nepetalactol to Nepetalactone

The NORs described above are useful for oxidizing nepetalactol to produce nepetalactone. This reaction occurs when a NOR is contacted with nepetalactol in the presence of NAD+ or NADP+. Where the NOR is expressed intracellularly and not secreted, the reaction can take place within the cell (in vivo), provided that the cell contains nepetalactol and NAD+ and/or NADP+(the cell may contain nepetalactol either because the cell produces nepetalactol or because the cell has taken up nepetalactol from the culture medium). Where the NOR is secreted from a cell, the reaction can be carried out in the culture medium, provided the culture medium contains nepetalactol and NAD+ and/or NADP+. In some embodiments, nepetalactol and NAD+ and/or NADP+ are simply added to the cell lysate for in vitro nepetalactone production, as was done in Example 1. In other embodiments, the NOR is purified from a cell lysate (if intracellular) or cell culture medium (if secreted), using protein purification methods described herein or known in the art. The NOR can, but need not, be purified to homogeneity. The resulting enzyme preparation can then be contacted with nepetalactol and NAD+ or NADP+ to produce nepetalactone in vitro.

In other in vitro production embodiments, a NOR is produced by CFPS and nepetalactol plus NAD+ and/or NADP+ are included in, or added to, the reaction mixture, where oxidation is carried out. In a variation of these embodiments, a NOR is produced by CFPS and partially or fully purified to produce an enzyme preparation that can then be contacted with nepetalactol and NAD+ or NADP+ to produce nepetalactone.

These methods enable industrial-scale production of nepetalactone, which can be used, for example, as or in insect repellents. Insect repellents can, for example, contain nepetalactone at a concentration in the range of about 1% to 30%, 2% to 28%, 3% to 25%, 4% to 23%, 5% to 20%, 6% to 18%, 7% to 15%, 8% to 13%, 9% to 10%, or any range bounded by any of these values. In particular, nepetalactone effectively repels cockroaches and mosquitos. Nepetalactone is the active ingredient in catnip and is therefore also useful as a cat attractant, e.g., in cat toys.

Methods of Converting Nepetalactone to Dihydronepetalactone

Dihydronepetalactone is an even more potent insect repellent than nepetalactone. Accordingly, it is advantageous, in some embodiments, to convert nepetalactone to dihydronepetalactone, which is conveniently accomplished by hydrogenation of nepetalactone. Catalysts such as platinum oxide and palladium supported on strontium carbonate give dihydronepalactone in 24-90% yields (Regnier, F. E., et al.

Phytochemistry 6:1281-1289 (1967)). The production of dihydronepetalactone and insect repellents based on this compound is described in European Patent No. 1484967 (also published as PCT Publication No. WO2003079786), which is incorporated by reference herein for this description.

The following examples are given for the purpose of illustrating various embodiments of the disclosure and are not meant to limit the present disclosure in any fashion. Changes therein and other uses which are encompassed within the spirit of the disclosure, as defined by the scope of the claims, will be identifiable to those skilled in the art.

Example 1—Cloning and Expression of Nepetalactone Oxidoreductases in *Escherichia coli* Capable of Converting Nepetalactol to Nepetalactone Identification of NOR Candidates Publicly available next-generation RNA sequencing data from *Nepeta cataria* was obtained from NCBI (SRR5150709). The reads were extracted and assembled into a transcriptome. The protein sequence for horse liver alcohol dehydrogenase (HLADH) was used as a BLAST query to identify alcohol dehydrogenases candidates from *Nepeta cataria* that might catalyze conversion of nepetalactol to nepetalactone.

Thirty-nine candidates were identified and the coding sequences were codon-optimized for expression in *E. coli*. The codon-optimized nucleotide sequences were synthesized with an upstream T7 promoter and a ribosome binding site (RBS) and a downstream T7 terminator sequence by Integrated DNA Technologies (IDT). Synthesized DNA was retrieved as plasmids containing the expression cassettes within a backbone containing the kanamycin resistance marker provided by IDT.

Heterologous Expression of NOR Candidates

The plasmids were individually transformed into chemically competent BL21 (DE3) cells. pUC19 was also transformed into BL21 (DE3) to produce a strain that could serve as a negative control. Transformants were selected and grown overnight with shaking in LB medium containing kanamycin. Glycerol stocks were prepared by mixing overnight culture with 50% glycerol in a 1:1 ratio. Glycerol stocks were frozen at −80° C.

BL21 (DE3) strains were streaked out on LB plates containing kanamycin from glycerol stock and grown overnight at 37 C. A single colony was inoculated into 4 mL of LB medium containing kanamycin in 15 mL disposable culture tubes and incubated overnight at 30° C. with shaking at 250 rpm. 500 µL of the overnight culture was subcultured into 50 mL of LB medium containing kanamycin in a 250 mL baffled flask. The culture was grown at 37° C. and the optical density at 600 nm (OD600) was monitored. When OD600 reached between 0.6-1, the cultures were cooled on ice for 15 minutes. The cultures were then induced with 100 µM of isopropyl β-D-1-thiogalactopyranoside and incubated at 15° C. with shaking at 250 rpm for roughly 20 hours. Cultures were pelleted by centrifugation in 50 mL centrifuge tubes. The supernatant was decanted and the pellets were frozen at −20° C. for later processing.

In Vitro Characterization of NOR Candidates

Pellets were thawed on ice and resuspended with 3 mL of cold lysis buffer: 50 mM sodium phosphate, pH=7.4, 100 mM sodium chloride. All remaining steps were performed either on ice or at 4° C. The cell mixture was transferred to a 15 mL centrifuge tube and disrupted with three rounds of sonication using the Branson Sonifier 450 with a double-level microtip at 70% amplitude. A single round of sonication consisted of 6 cycles of 10 seconds with the sonicator on, and 10 seconds off. Between each round, the cell mixture was allowed to sit on ice for a minute to cool. The lysed cell mixture was transferred to 1.7 mL centrifuge tubes and centrifuged at maximum speed in a microcentrifuge for 20 minutes. The supernatant (clarified cell lysate) was collected in a separate tube and used for in vitro characterization.

The in vitro reactions were setup as follows: 2 µL of 100 mM NAD+ or NADP+ and 10 µL of 100 uM nepetalactol was added to 188 µL of the clarified cell lysate. The reactions were incubated at 30° C. shaking at 200 rpm for 2 hours. As a positive control, 2 µL of 100 mM NAD+, 2 µL of 100 mM NADP+ and 10 µL of 100 µM nepetalactone was added to 186 µL of clarified lysate from a strain harboring pUC19 and incubated for 1 hr. The reactions were extracted with one volume of ethyl acetate. The organic layer was withdrawn and analyzed with gas chromatography coupled to mass spectrometry (GC-MS). Authentic standards were run to confirm identities of analytes.

Figures 2A, 2B:
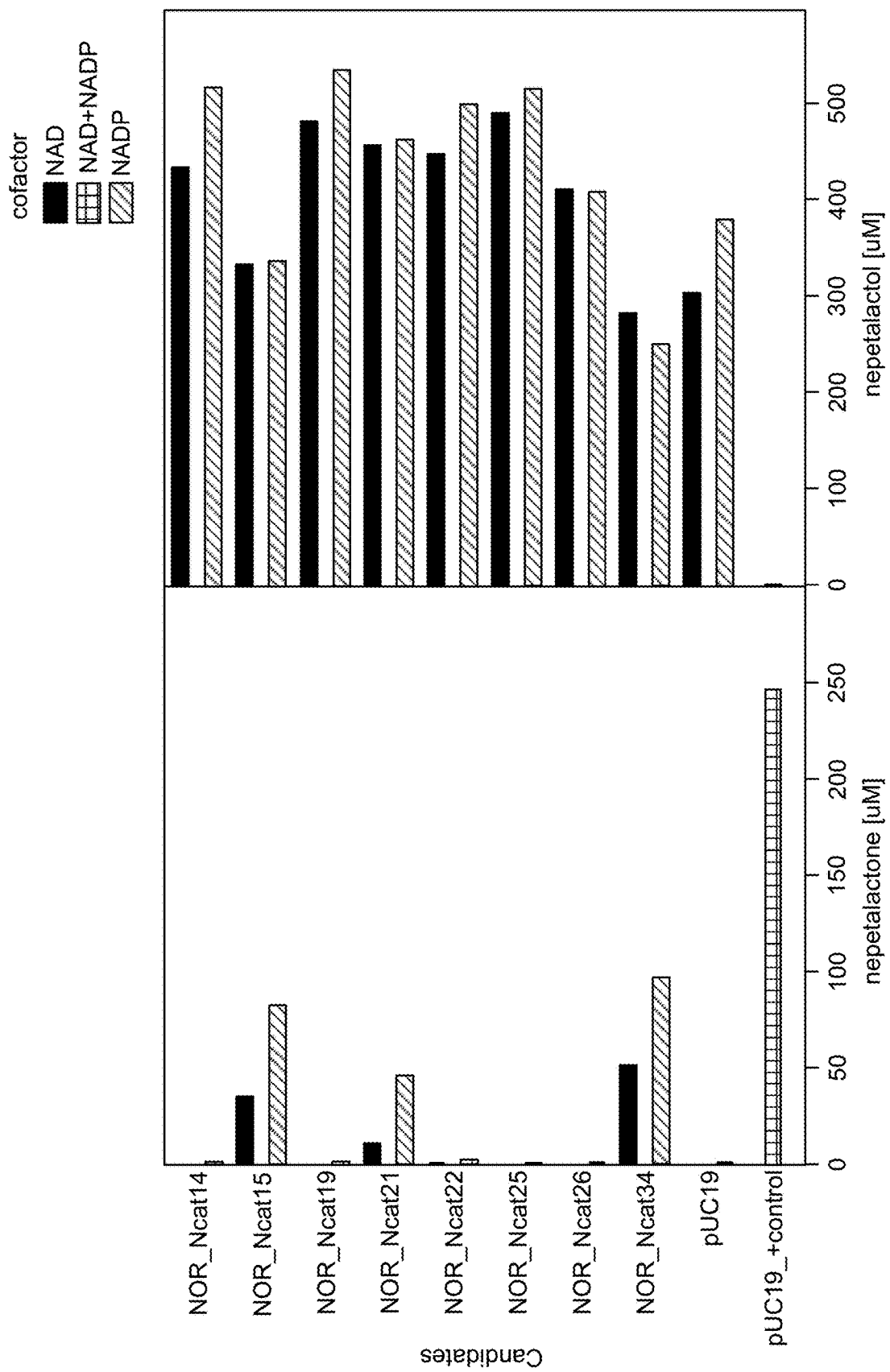
FIG. 2A-B: Conversion of nepetalactol to nepetalactone by candidate nepetalactol oxidoreductases (NORs). See Example 1. (A) Nepetalactone produced in the presence of NAD$^-$ (nicotinamide adenine dinucleotide, NAD) and/or NADP$^+$ (nicotinamide adenine dinucleotide phosphate, NADP) in clarified cell lysates from cells expressing various candidate NORs. (B) Concentration of residual nepetalactol after reaction. The results show that three candidate NORs (NcatNOR15, NcatNOR21, and NcatNOR34) can covert nepetalactol to nepetalactone.

The results are shown in FIG. 2. Three candidate genes NcatNOR15 (protein SEQ ID NO: 561), NcatNOR21 (protein SEQ ID NO: 566), and NcatNOR34 (protein SEQ ID NO: 578) [(DNA SEQ ID NOs:1725-1727)] were found to encode NORs which can oxidize nepetalactol to nepetalactone, the first such demonstration.

Example 2—Introduction of Biosynthetic Pathway for Nepetalactone into Yeast Plasmid/DNA Design All plasmids were designed using proprietary software. Genes were synthesized by a third-party and plasmids were assembled by standard DNA assembly methods either in-house or by a third-party. The plasmid DNA was then used to chromosomally integrate the metabolic pathway inserts into *Saccharomyces cerevisiae*.

Plasmids were designed for 'two plasmid, split-marker' integrations. Briefly, two plasmids were constructed for each targeted genomic integration. The first plasmid contains an insert made up of the following DNA parts listed from 5' to 3': 1) a 5' homology arm to direct genomic integration; 2) a payload consisting of cassettes for heterologous gene expression; 3) the 5' half of a URA3 selection marker cassette. The second plasmid contains an insert made up of the following DNA parts listed from 5' to 3': 1) the 3' half of a URA3 selection marker cassette with 100 bp or more DNA overlap to the 3' end of the 5' half of the URA selection marker cassette used in the first plasmid; 2) an optional payload consisting of cassettes for heterologous gene expression; 3) a 3' homology arm to direct genomic integration. The inserts of both plasmids are flanked by meganuclease sites. Upon digestion of the plasmids using the appropriate meganucleases, inserts are released and transformed into cells as linear fragments. A triple-crossover event allows integration of the desired heterologous genes and reconstitution of the full URA3 marker allowing selection for uracil prototrophy. For recycling of the URA3 marker, the URA3 cassette is flanked by 100-200 bp direct repeats, allowing for loop-out and counter-selection with 5-Fluoroorotic Acid (5-FOA).

Cassettes for heterologous expression contain the gene coding sequence under the transcriptional control of a promoter and terminator. Promoters and terminators may be selected from any elements native to *S. cerevisiae*. Promoters may be constitutive or inducible. Inducible promoters include the bi-directional pGAL1/pGAL10 (pGAL1-10) promoter and pGAL7 promoter, which are induced by galactose.

Strain Construction

Cells were grown in yeast extract peptone dextrose (YPD) overnight at 30° C., shaking at 250 rpm. The cells were diluted to an optical density at 600 nm (OD600)=0.2 in 50 mL of YPD and grown to an OD600=0.6-0.8. Cells were harvested by centrifugation, washed with water, washed with 100 mM lithium acetate, and resuspended in 100 mM lithium acetate to a final OD600=100. 15 µL of the cell resuspension was directly added to the DNA. A PEG mixture containing 100 µL of 50% w/v PEG3350, 4 µL of 10 mg/mL salmon sperm DNA, 15 µL of 1 M lithium acetate was added to the DNA and cell mixture, and well-mixed. The transformation mix was incubated at 30° C. for 30 min and 42° C. for 45 min.

Following heat-shock, the transformation mix was plated on agar plates containing synthetic defined minimal yeast media lacking uracil (SD-URA). Plates were incubated at 30° C. for 2-3 days. Up to eight transformants were picked for each targeted strain into 1 mL of SD-URA liquid media of a 96-well plate and grown at 30° C. with shaking at 1000 rpm and 90% relative humidity (RH). Cultures were lysed using Zymolyase, and a PCR was performed using the resulting lysate to verify successful integration using primers that targeted the 5' integration junction. Glycerol stocks were prepared from the cultures at a final concentration of 16.6% glycerol and were stored at −80° C. for later use.

To recycle the URA3 selection marker, selected strains were inoculated into SD-URA and grown overnight at 30° C., 1000 rpm and 90% RH. Strains were then plated onto 0.1% 5-FOA plates (Teknova) and incubated at 30° C. for 2-3 days. Single colonies were re-streaked onto 0.1% 5-FOA plates. Single colonies were selected from the re-streak and colony PCR was performed in order verify loop-out of the URA3 marker. Colonies were also tested for lack of growth in liquid SD-URA medium. Further integrations were performed as described above.

Strain Cultivation and Target Compound Production

From the frozen glycerol stocks, successful integrants were inoculated into a seed plate containing 300 µL of SD-URA. The 96-well plate was incubated at 30° C., 1000 rpm, 90% RH for 48 hours. For each successfully built strain, three biological replicates were tested. If fewer than three successful transformants were obtained for each targeted strain genotype, the existing biological replicates were duplicated. Strains were randomized across a 96-well plate. After the 48 hours of growth, 8 µL of the cultures from the seed plates were used to inoculate a main cultivation plate containing 250 µL of minimal medium with 2% glucose and grown for 16 hour at 30° C., 1000 rpm, 90% RH. 50 µL of minimal medium with 12% galactose was added to the cultures to induce expression of heterologous genes under the control of galactose promoters, followed by the addition of 30 µL of methyl oleate. After 9 hours of additional growth, 3 µL of a 50 mg/mL substrate feed (geraniol or 8-hydroxygeraniol) prepared in DMSO was dispensed into the cultures. Cells were grown for an additional 15 hours before assays were performed to assess cell growth and titer.

Cell density was determined using a spectrophotometer by measuring the absorbance of each well at 600 nm. 20 µL of culture was diluted into 180 µL of 175 mM sodium phosphate buffer, pH 7.0 in a clear-bottom plate. The plates were shaken for 25 s at 750 rpm immediately before being measured on a Tecan M1000 spectrophotometer. A non-inoculated control well was included as a blank.

300 µL of ethyl acetate was added to the cultures. The plates were sealed with a PlateLoc Thermal Microplate Sealer and the plates were shaken for one min at 750 rpm. The plates were centrifuged and the ethyl acetate layer was collected and analyzed by liquid chromatography coupled to mass spectrometry (LC-MS). Target analytes were quantified against authentic standards.

Figure 6A:
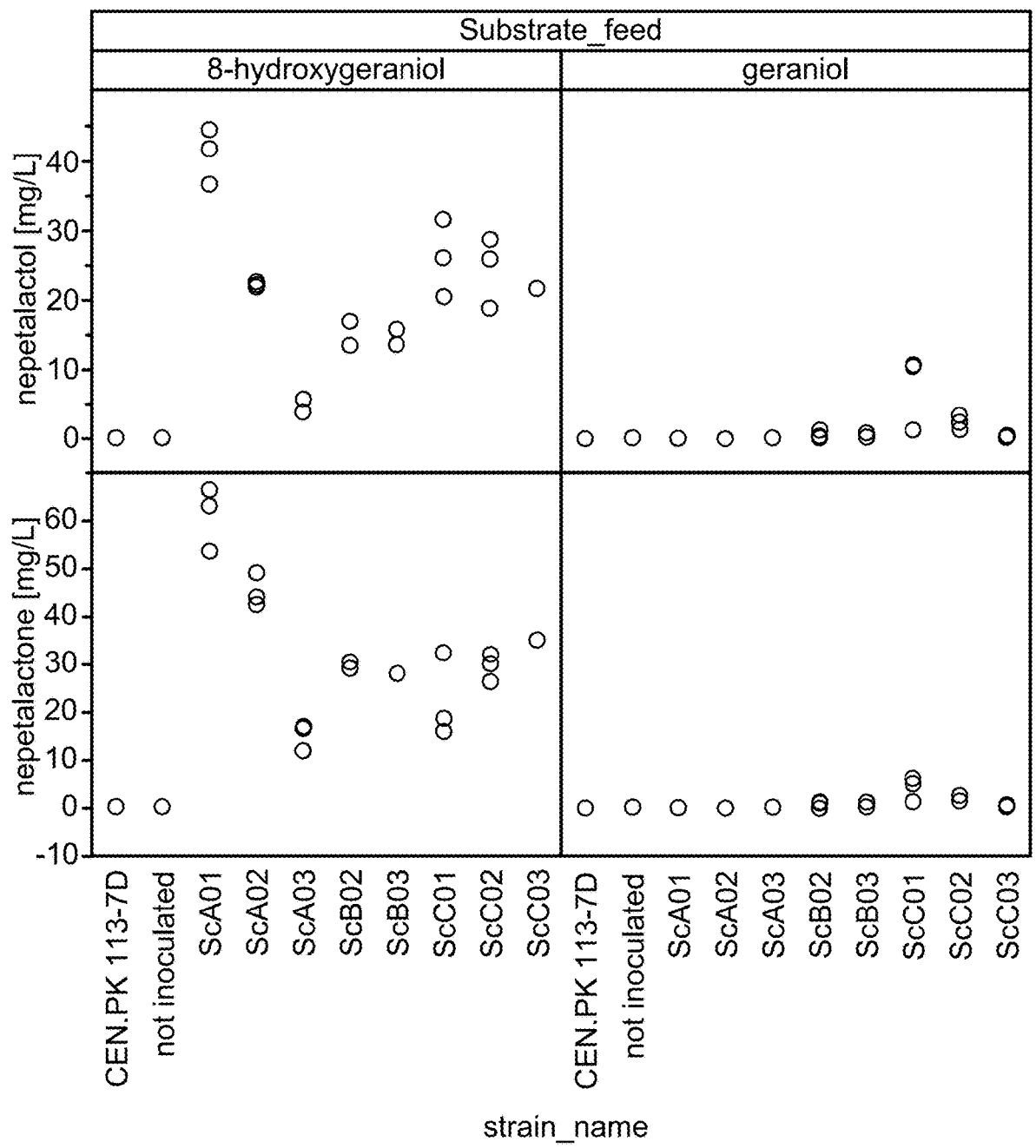

FIG. 6-A displays the nepetalactone and nepetalactol titers of several engineered strains compared to non-inoculated control wells and the wild-type strain, CEN.PK113-7D. FIG. 6-B displays the strain genotypes. FIG. 6-C displays the source organism of the pathway genes. All engineered strains in FIG. 6-A produced nepetalactone and nepetalactol with an 8-hydroxygeraniol feed with maximum titers of 66.7 mg/L nepetalactone and 44.4 mg/L nepetalactol. Under identical conditions, no nepetalactone and nepetalactol was observed in the non-inoculated control wells and the wild-type strain. Only some of the engineered strains produced the same products with a geraniol substrate feed; generally, the titers were lower with a geraniol substrate feed with maximum titers of 6.1 mg/L nepetalactone and 10.6 mg/L nepetalactol. With the geraniol substrate feed, no nepetalactone and nepetalactol was observed in wells that were non-inoculated or that contained the wild-type strain. Only the cis,trans-nepetalactone isomer was produced.

Example 3—Expression and Activities of Various Iridoid Synthases

Figure 3:
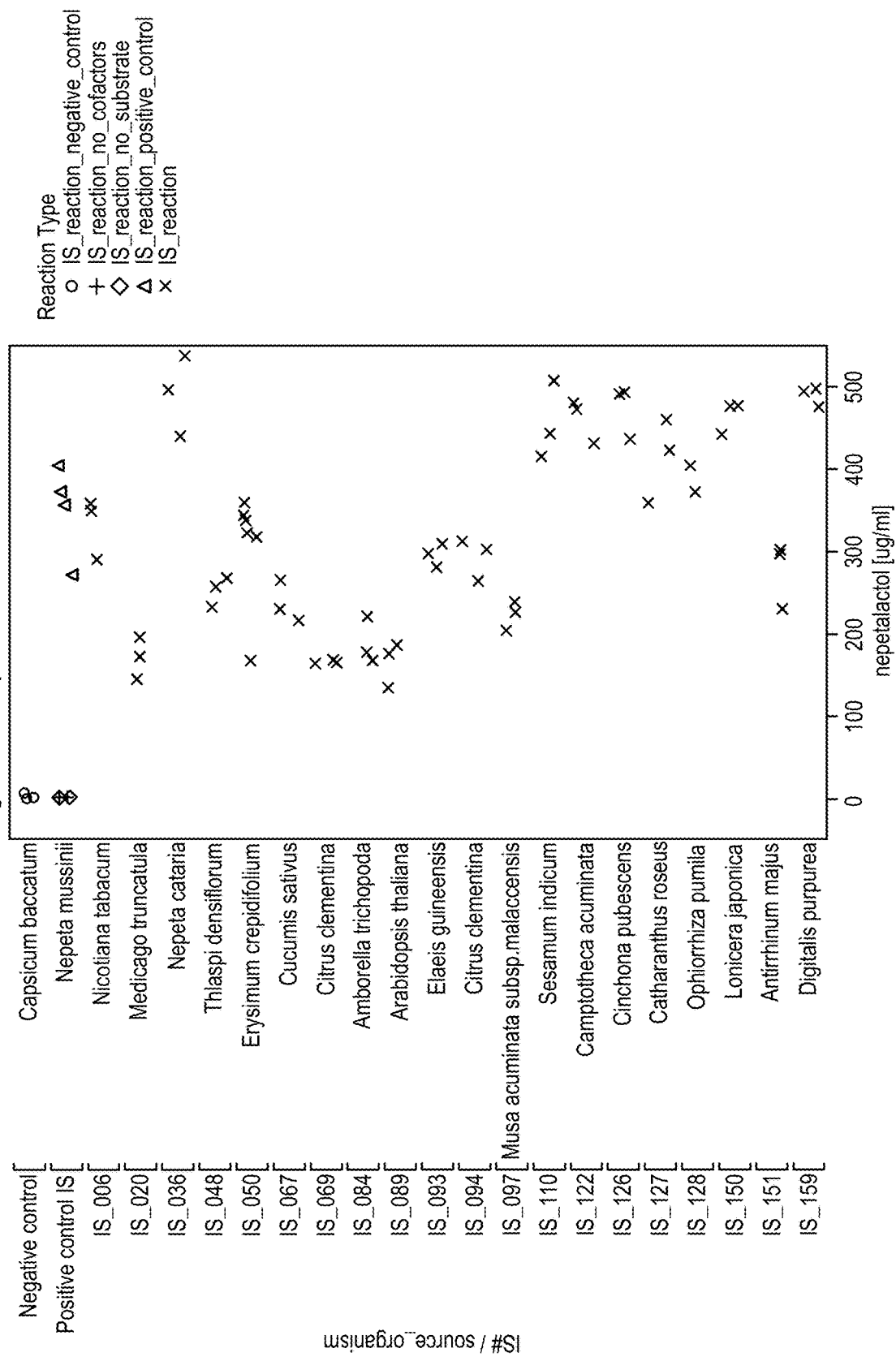
FIG. 3: In vitro conversion of 8-oxogeranial to nepetalactol in the presence of iridoid synthase (ISY), NADH, and NADPH. The symbols for "IS reaction no cofactors" and "IS reaction no substrate" overlap for N. mussinii. See Example 3.

A variety of iridoid synthases (ISYs, SEQ ID NOs: 1181, 1256, 1257, 1306, 1191, 1255, 1269, 1203, 1791, 1801, 1215, 1281, 1190, 1217, 1800, 1234, 1277, 1233, 1300, 1249, 1805) were heterologously expressed in *E. coli* from a plasmid using a T7 expression system. *E. coli* cultures were grown until OD600~0.6 and induced with 1 mM IPTG and grown for 7.5 h at 28° C. or 20 h at 15° C. Cells were harvested and chemically lysed by Bugbuster HT (EMD Millipore) following manufacturer's instructions. Cell lysates were clarified by centrifugation and were tested for in vitro conversion of 8-oxogeranial to nepetalactol in the presence of NADH and NADPH (see FIG. 3). 2 µL of cell lysate was added to a reaction mixture containing 200 mM HEPES, pH=7.3, 100 µM of 8-oxogeranial, 100 µM NADH and 100 µM of NADPH. The reaction mixture was extracted with 300 µL of ethyl acetate. The organic extract was analyzed by LC-MS for quantification of nepetalactol.

Example 4—Cloning and Expression of Nepetalactol Synthases Capable of Producing Nepetalactol Four putative nepetalactol synthases (NEPS_1 to NEPS_4; SEQ ID NO: 1518-1521) were identified by examining publicly available transcriptome data (medicinalplant-genomics.msu.edu) from four plant species that are known to produce monoterpene indole alkaloids (*Catharanthus roseus, Camptotheca acuminata, Vinca minor*, and *Rauvolfia serpentina*). Transcripts that encoded these NEPS were highly co-expressed with biosynthetic gene homologs that catalyze the formation of loganic acid from geraniol, which proceeds through the intermediate, nepetalactol. This analysis suggested the involvement of these NEPS candidates in the biosynthesis of loganic acid from geraniol, perhaps in nepetalactol formation. All four NEPSs were heterologously expressed in *E. coli* from a plasmid using a T7 expression system. *E. coli* cultures were grown until OD600~0.6 and induced with 100 µM IPTG and grown for 16 h at 16° C.

Figure 4:
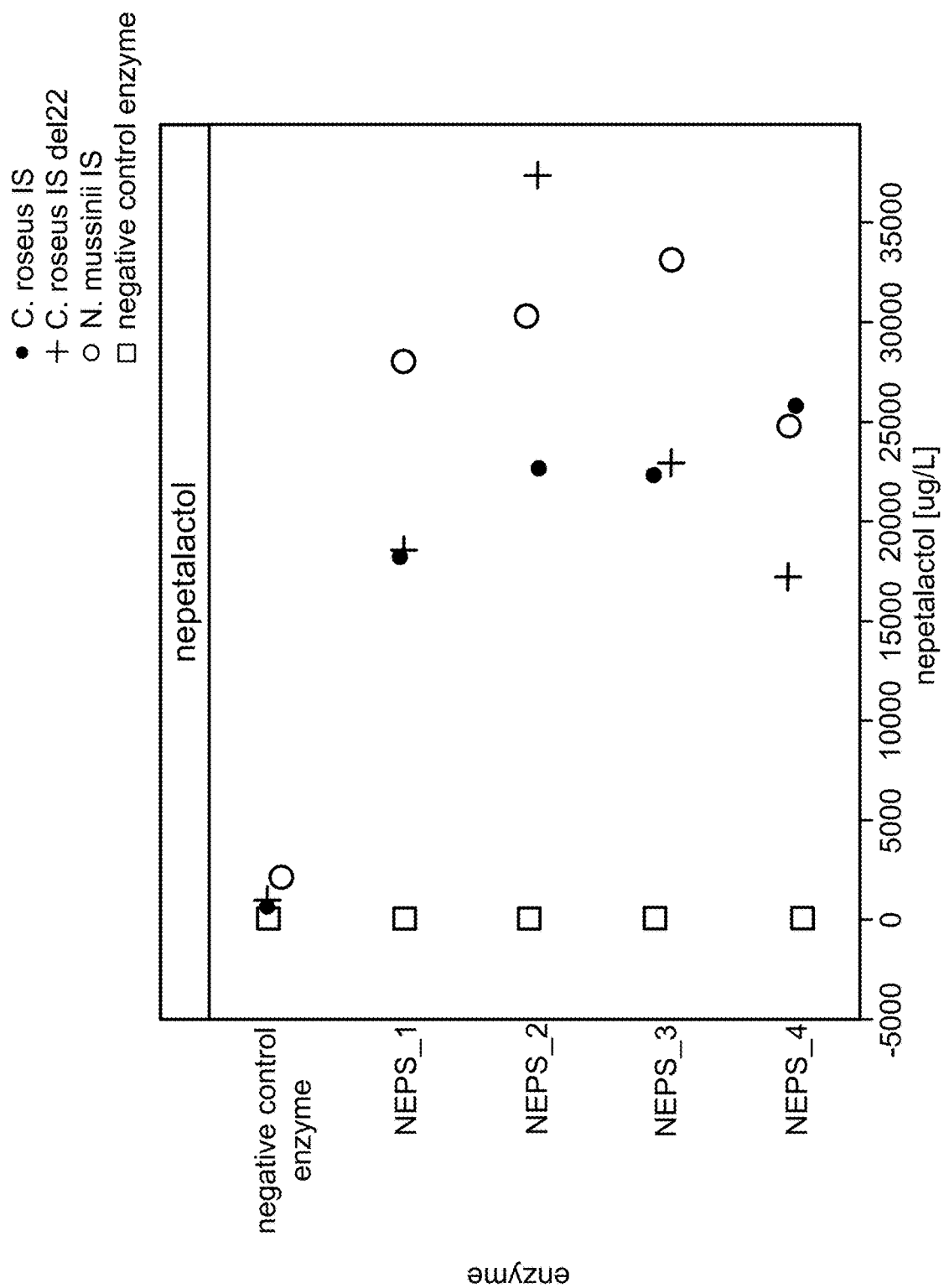
FIG. 4: In vitro conversion of 8-oxogeranial in the presence of iridoid synthase (ISY, IS), nepetalactol synthase (NEPS) and NADPH. Catharanthus roseus ISY del22 is truncated at the N-terminus by 22 amino acids.

Cells were harvested and chemically lysed by Bugbuster HT (EMD Millipore) following manufacturer's instructions. Cell lysates were clarified by centrifugation. NEPS activity was tested individually by the addition of 10 μL of cell lysate to a reaction mixture containing 50 mM HEPES, pH=7.3, 500 μM of 8-oxogeranial, 1 mM NADPH and 10 μL of cell lysate that contains one of three iridoid synthases (ISY) in a final volume of 200 μL. The ISYs include *Catharanthus roseus* iridoid synthase (ISY; SEQ ID NO. 1162), *C. roseus* ISY "del22" (SEQ ID NO. 1166), which is truncated at the N-terminus by 22 amino acids, and *Nepeta mussinii* ISY (SEQ ID NO. 1159) (see FIG. 4). The reaction mixture was extracted with 300 μL of ethyl acetate, and the organic layer was analyzed by LC-MS for the quantification of nepetalactol. In every case, the presence of the NEPS enhanced production of nepetalactol (11- to 40-fold increase) compared to in vitro reactions that contained cell lysate from *E. coli* that did not express NEPS.

Example 5—Expression and Activities of Various 8-Hydroxygeraniol Oxidoreductases A variety of 8-hydroxygeraniol oxidoreductases (8HGOs; SEQ ID NO: 1132, 1134, 1136, 1138-1146) were heterologously expressed in *E. coli* from a plasmid using a T7 expression system. *E. coli* cultures were grown until OD600~0.6 and induced with 100 μM IPTG and grown for 16 h at 16° C. Cells were harvested and chemically lysed by Bugbuster HT (EMD Millipore) following manufacturer's instructions. Cell lysates were clarified by centrifugation. 8HGO activity was tested by the addition of 1 μL of cell lysate to a reaction mixture containing 50 mM of bis-tris propane, pH=9.0, 1 mM NADPH, 1 mM NAD+, 500 μM of 8-hydroxygeraniol, 1 μL of cell lysate containing *Nepeta mussinii* ISY (SEQ ID NO: 1159) and 1 μL of cell lysate containing NEPS_1 (SEQ ID NO: 1518) in a final reaction volume of 100 μL. The reaction mixture was extracted with 300 μL of ethyl acetate, and the organic layer was analyzed by LC-MS for quantification of nepetalactol. (see FIG. 5).

Example 6—Cloning and Expression of Nepetalactone Oxidoreductases in *Saccharomyces cerevisiae* Capable of Converting Nepetalactol to Nepetalactone Identification of NOR Candidates An additional list of seventeen candidates were identified from the de novo transcriptome assembly produced above in EXAMPLE 1. Briefly, hmmscan from the software, HMMER was used to functionally annotate all predicted peptides from the assembly based on their best matching Pfam hidden markov model (HMM) by E-value. All HMMs related to oxidoreductase activity were investigated further by BLAST and filtered to remove sequences with high sequence identity to any sequences from the non-redundant database to further narrow the list of candidates. The sequences of these candidates and the original thirty-nine candidates described in EXAMPLE 1 were codon-optimized for expression in *S. cerevisiae* (SEQ ID NO: 1340-1395) and were synthesized by a third-party and cloned into the 2μ plasmid backbone, pESC-URA.

Heterologous Expression and Testing of NOR Candidates

The plasmids were individually transformed into chemically competent *Saccharomyces cerevisiae* cells as described in EXAMPLE 2. Transformants were selected on SD-URA agar plates. Three to four replicates were picked into SD-URA liquid medium and cultured at 30° C. for one to two days with shaking at 1000 rpm. Cultures were glycerol stocked at a final concentration of 16.6% glycerol and stored at −80° C. until later use.

10 μL of the glycerol stocked strains was inoculated into 300 μL of minimal media lacking uracil, and containing 4% glucose in 96-well plates to produce seed cultures. The plates were incubated at 30° C. at 1000 rpm for 1-2 days. 10 μL of the seed cultures was then inoculated into 300 μL of minimal media lacking uracil, and containing 2% galactose and 100 mg/L of nepetalactol. 30 μL of methyl oleate was next added to the wells. The main culture plates were further incubated at 30° C., 1000 rpm for 24 hours before assays were performed to assess cell growth and titer. Cell growth and titer assays were performed as described above in EXAMPLE 2.

Figure 7:
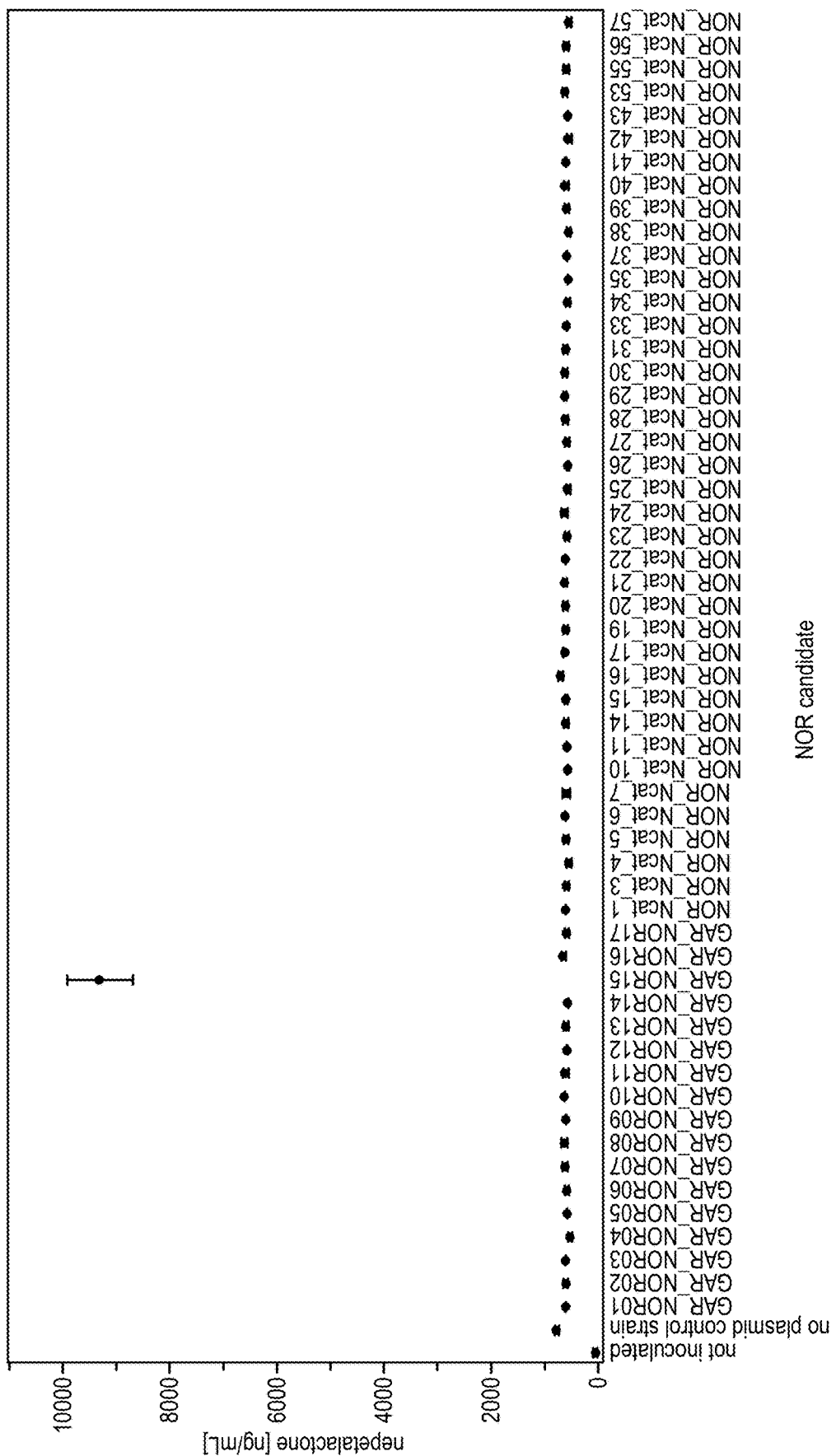
FIG. 7: Production of nepetalactone from nepetalactol in engineered *Saccharomyces cerevisiae* strains expressing NOR candidates from a 2μ plasmid (pESC-URA). See Example 6.

All tested strains produced at least some basal level of nepetalactone (~600 ug/L; see FIG. 7), including a control strain that did not contain a plasmid for expression of a NOR candidate. No nepetalactone was observed in the non-inoculated control wells. Altogether, these results suggest that *Saccharomyces cerevisiae* has low background levels of NOR activity. One of the tested strains expressing GAR NOR15 (SEQ ID NO: 1393) produced significantly more nepetalactone (93 mg/L), far exceeding basal levels, and demonstrating that this heterologous protein candidate has activity for converting nepetalactol into nepetalactone.

REFERENCES

1. U.S. Pat. No. 8,512,988B2, entitled "Microbial engineering for the production of chemical and pharmaceutical products from the isoprenoid pathway," filed Nov. 10, 2010, published Aug. 20, 2013.
2. U.S. Pat. No. 8,206,957B2, entitled "Process for the enzymatic preparation of citronellal," filed Jun. 27, 2008, published Jun. 26, 2012.
3. WO2015189428A1, entitled "Method of producing terpenes or terpenoids," filed Jun. 15, 2015, published Dec. 17, 2015.
4. WO2016008883A1, entitled "Biosynthesis of monoterpenes in cyanobacteria," filed Jul. 14, 2015, published Jan. 21, 2016.
5. Hallahan, et al. (1998) "Nepetalactol oxidoreductase in trichomes of the catmint *Nepeta racemose*," Phytochemistry 48(3): 421-427.
6. Dewick (2002) "The biosynthesis of C5-C25 terpenoid compounds," Nat Prod Rep. 19(2):181-222.
7. Campell, et al. (2016) "Engineering of a Nepetalactol-Producing Platform Strain of *Saccharomyces cerevisiae* for the Production of Plant Seco-Iridoids," ACS Synth Biol. 5(5):405-14.
8. Krithika, et al. (2015) "Characterization of 10-hydroxygeraniol dehydrogenase from *Catharanthus roseus* reveals cascaded enzymatic activity in iridoid biosynthesis," Sci Rep. 5:8258.
9. Lichman, et al. (2018) "Uncoupled activation and cyclisation in catmint reductive terpenoid biosynthesis," bioRxiv doi: doi.org/10.1101/391953 (Posted Aug. 14, 2018).

SEQUENCE LISTING (1807 sequences)

SEQ ID NO: 1 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIDQLYHEYEESVAKDLKAKISQVDESRGFKADVLTAFLNKVYKRSK

SEQ ID NO: 2 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFETAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 3 - protein, 296 aa, Abies grandis
MFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 4 - protein, 360 aa, Catharanthus roseus
MANVGQQVQRQSNSVAEEPLDPFSLVADELSILANRLRSMVVAEVPKLASAAEYFFKLGVEGKRFRPTVLLLMATAIDAPISRTPPDTSLDTLSTELRLRQQTIAEITKMIHVASLLHDDVLDDAETRRGIGSLNFVMGNKLAVLAGDFLLSRACVALASLKNTEVVSLLATVVEHLVTGETMQMTTTSDQRCSMEYYMQKTYYMTASLISNSCKAIALLAGQTSEVAMLAYEYGKNLGLAFQLIDDVLDFTGTSASLGKGSLSDIRHGIVTAPILFAIEEFPELRAVVDEGFENPYNVDLALHYLGKSRGIQRTRELAIKHANLASDAIDSLPVTDDEHVLRSRRALVELTQRVITRRK

SEQ ID NO: 5 - protein, 297 aa, Picea abies
MEFDFDKYMHSKAIAVNEALDKVIPPRYPQKIYESMRYSLLAGGKRVRPILCIAACELMGGTEELAMPTACAIEMIHTMSLIHDDLPYIDNDDLRRGKPTNHKVFGEDTAIIAGDALLSLAFEHVAVSTSRTLGTDIILRLLSEIGRATGSEGVMGGQVVDIESEGDPSIDLETLEWVHIHKTAVLLECSVVCGAIMGGASEDDIERARRYARCVGLLFQVVDDILDVSQSSEELGKTAGKDLISDKATYPKLMGLEKAKEFADELLNRGKQELSCFDPTKAAPLFALADYIASRQN

SEQ ID NO: 6 - protein, 297 aa, Geobacillus sp.
MAQLSVEQFLNEQKRAVEAALSSYMARLRGPETLKKAMAYSLEAGGKRIRPLLLLATIQALGKDPAIGLPVACAIEMIHTYSLIHDDLPSMDNDDLRRGKPTNHKVFGEAMAILAGDALLTYAFQLIAEVDDDRVPPSVRLQLIEQLAKAAGPEGMVAGQAADMEAEGKTLALAELEYIHRHKTGKMLQYSVHAGALLGGADGRQTRELNEFAAHLGLAFQIRDDILDIEGMEEKIGKRVGSDRDNKKATYPVLLSLGGAKEKLAFHIDAAKRHLQQAKIDDAVLAYICELVAVRDH

SEQ ID NO: 7 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFGTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 8 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 9 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 10 - protein, 347 aa, Neosartorya fumigata
MATTTSRAAFEAVFPTLAEDLLAHAKKYNLPENAVKWFEQVLNVNVPGGKLNRGLSVPDTGIALLQKPLTDEQFKHLSILGWLTELLQAFFLVSDDMMDSSITRRGQPCWYRHPGVGLIAINDAFMLESGIYVILKKHFRSHPAYVDFLELFHETTWQTELGQLCDLITAPEDKVDLDNFSMEKYMFIVTYKTAYYSFYLPVALALLYLELATPENLQQTHDILIPLGQYFQVQDDYLDAYGDPAVIGKIGTDIQDNKCSWLINQALQRCNTEQRKLLDTAYGRKDSELEAKVKALYKELDLEKVYKEYEEKTVGEIRRKIAAIDESQGLKKEVFEAFLGKIYKRTK

SEQ ID NO: 11 - protein, 365 aa, Catharanthus roseus
MCVSSALANVGQQVQRQSNSVAEEPLDPFSLVADELSILANRLRSMVVAEVPKLASAAEYFFKLGVEGKRFRPTVLLLMATAIDAPISRTPPDTSLDTLSTELRLRQQSIAEITEMIHVASLLHDDVLDDAETRRGIGSLNFVMGNKLAVLAGDFLLSRACVALASLKNTEVVSLLATVVEHLVTGETMQMTTTSDQRCSMEYYMQKTYYKTASLISNSCKAIALLAGQTSEVAMLAYEYGKNLGLAFQLIDDVLDFTGTSASLGKGSLSDIRHGIVTAPILFAIEEFPELRAVVDEGFENPYNVDLALHYLGKSRGIQRTRELAIKHANLASDAIDSLPVTDDEHVLRSRRALVELTQRVITRR

SEQ ID NO: 12 - protein, 304 aa, Rhizobium acidisoli
MDANRDTFETRLKNNAREIEALLDALLLPNALSDEIARPETLRSAMHYAVLNGGKRLRPFLVVESAALLGGDDEAARRVGAALECVHCYSLVHDDLPAMDDDDLRRGKPTVHIKFDEATAILAGDSLLTYAFDIIAAPETALADTSKASLVLALARAAGLGGMAGGQALDLAAEKQAPDEAGIIRLQAMKTGALIRFACEAGALIAASPPEDRRRLRAFGEKIGLAFQLADDILDLTSDTATMGKATGKDAARGKGTLVALHGIEWAEEQLRQHVRDAEALLAPYGARASTLIAAAHFIADRKS

SEQ ID NO: 13 - protein, 299 aa, Escherichia coli
MDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 14 - protein, 299 aa, Escherichia coli
MDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 15 - protein, 304 aa, Brucella suis
MEKLPVDFTTLLNRRAMEVEAALAGLLDECPRTGEIARPQRLIAAMRHGVLNGGKRLRPFLVLESAALFGQYGQAVLRVAAALECIHCYSLVHDDLPAMDDDDLRRGQPTVHKAFDEAAAILAGDSLLTYAFDIIASDETELDATTRIKLVCALTRASGLGGMAGGQALDLMAETRKPDEAGIITLQAMKTGALIRFACEAGAIIAGASQEDRERMAEFGSAIGLAFQLADDLLDVTADAGTMGKATGKDAAAGKATLVSLHGIDWTRQQLSGLVAQAESLLAPFGEDAEPLKQAARFIAERQN

SEQ ID NO: 16 - protein, 339 aa, Arabidopsis thaliana
MFSLVADELSLLSNKLREMVLAEVPKLASAAEYFFKRGVQGKQFRSTILLLMATALNVRVPEALIGESTDIVTSELRVRQRGIAEITEMIHVASLLHDDVLDDADTRRGVGSLNVVMGNKMSVLAGDFLLSRACGALAALKNTEVVALLATAVEHLVTGETMEITSSTEQRYSMDYYMQKTYYKTASLISNSCKAVAVLTGQTAEVAVLAFEYGRNLGLAFQLIDDILDFTGTSASLGKGSLSDIRHGVITAPILFAMEEFPQLREVVDQVEKDPRNVDIALEYLGKSKGIQRARELAMEHANLAAAAIGSLPETDNEDVKRSRRALIDLTHRVITRNK

SEQ ID NO: 17 - protein, 282 aa, Buchnera aphidicola
MHFFHLYERYKHRINQKLFYTLNQLPFQKSSLLKAMKYSVFSGSKRLRSSLIYSTGDVFKVNITTLDVISTAIEFIHSYSLIHDDLPCMDNDNFRRGKISCHVKYGESTSLLAGDALQSLAFNILSNSFMPNVSNLKRIKMISELSYSIGSSGMCMGQNLDLEAEKKDVNLSELEIINLYKTSFLMRSAVRLVYFSSNNFSKSILSILDLFSISIGLAFQIQDDILDFKKDSVKTDNKKIIKKHTYPLIIGLDESRKKIKQLHKKSFLALNSLKKKISIPTY

SEQ ID NO: 18 - protein, 355 aa, Dendroctonus ponderosae
MIRPVQSSALVTKEQSRDFMALFPDLVRELTEVGKSQELPDVMRRFARVLQYNTPTGKKNRGLIVLSTYRMLEDPEKLTPENIRLASILGWCVEMVHAYFLILDDIMDGSETRRGALCWFRQSGIGLTAVNDAVMIENAVYLLIKRHLKDHPMYVPLMELFHEGNLKTTLGQSLDAMCLDTNGKPKLDMFTMSRYTSIVKYKTAFYSFQMPVAIAMYLAGMSDEEQHRQAKTILMEMGQFFQIQDDFLDCFGDPTVTGKVGTDIQDGKCSWLAVVALQRASPAQRKIMEEHYGRPEPESIARIKNLYVDLCLPNTYAIYEEESFNIIKTHIQQISKGLRHDLFFKIMEKIYKREC

SEQ ID NO: 19 - protein, 314 aa, Picea abies
MKALVQLADLSEQVKNVVEFDFDKYMHSKAIAVNEALDKVIPPRYPQKIYESMRYSLLAGGKRVRPILCIAACELMGGTEELAMPTACAIEMIHTMSLIHDDLPYIDNDDLRRGKPTNHKVFGEDTAIIAGDALLSLAFEHVAVSTSRTLGTDIILRLLSEIGRATGSEGVMGGQVVDIESEGDPSIDLETLEWVHIHKTAVLLECSVVCGAIMGGASEDDIERARRYARCVGLLFQVVDDILDVSQSSEELGKTAGKDLISDKATYPKLMGLEKAKEFADELLNRGKQELSCFDPTKAAPLFALADYIASRQN

SEQ ID NO: 20 - protein, 300 aa, Abies grandis
MKAVEFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 21 - protein, 371 aa, Corynebacterium glutamicum
MKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 22 - protein, 347 aa, Vitis vinifera
MLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 23 - protein, 319 aa, Picea abies
MLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPPMDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 24 - protein, 319 aa, Picea abies
MLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTYSLIHDDLPPMDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 25 - protein, 353 aa, Sus scrofa
MNGDQKLDAYARERQDFIQHFSQIVKVLTEEDIGHPEIGDAVARLKEVLEYNVVGGKYNRGITVLVVFRELVEPRKQDADSLQRALTVGWCIELLQAFFLVADDIEDSSLTRRGQTCWYRKPGIGLDAINDAFLLEACIYRLLKFYCREQPYYLNLIELFLQTSYNTEIGQTLDLIAGPQGNVDLSRFTEKRYKSIVKYKTAFYSFYLPVAAAMYMAGIDGEKEHANAKKILMEMGEFFQIQDDYLDLFGDPSVTGKIGTDIQDNKCSWLVVQCLQRASPEQRQILQENYGQKDAEKVARVKALYEEMNLQAVFLQYEEDSYSHLMGLIEQYAAPLPPAIFLELAHKIYKRRK

SEQ ID NO: 26 - protein, 353 aa, Acyrthosiphon pisum
MPVITGTAVSKDETRDFMAVFPDVVRDLTDTGRNLDVPDVTKWLAKLLQYNVPGGKKNRGLALVLSYKMLSSPADQTDENIRLSYILGWCVEILQAYQLVLDDIMDNAITRRGRPCWYRHNDIGLMAVNDGVLLEQSIYQLIKKYFKDKPYYTHILELFYDVTMKTSMGQCLDMLTANSFKSKKLEKYTMENYTAIVKYKTAYYSFFLPVCLAMRMTNINDPEIFRQAKTILLEMGHFFQVQDDFLDCYGDPDVMGKIGTDIEDGKCSWLAVVALQKVNSEQKKIMEDNYGIDNPANVAVIKDLYAQLKLPDTFHLYEEESYKLICTHIQQLSRGLSQDMFFKFLEKIYKRTL

SEQ ID NO: 27 - protein, 359 aa, Mycobacterium tuberculosis
MRGTDEKYGLPPQPDSDRMTRRTLPVLGLAHELITPTLRQMADRLDPHMRPVVSYHLGWSDERGRPVNNNCGKAIRPALVFVAAEAAGADPHSAIPGAVSVELVHNFSLVHDDLMDRDEHRRHRPTVWALWGDAMALLAGDAMLSLAHEVLLDCDSPHVGAALRAISEATRELIRGQAADTAFESRTDVALDECLKMAEGKTAALMAASAEVGALLAGAPRSVREALVAYGRHIGLAFQLVDDLLGIWGRPEITGKPVYSDLRSRKKTLPVTWTVAHGGLAGRRLAAWLVDETGSQTASDDELAAVAELIECGGGRRWASAEARRHVTQGIDMVARIGIPDRPAAELQDLAHYIVDRQA

SEQ ID NO: 28 - protein, 293 aa, Staphylococcus aureus
MTNLPMNKLIDEVNNELSVAINKSVMDTQLEESMLYSLNAGGKRIRPVLLLLTLDSLNTEYELGMKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDTTKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 29 - protein, 297 aa, Geobacillus sp.
MAQLSVEQFLNEQKRAVEAALSSYMARLRGPETLKKAMAYSLEAGGKRIRPLLLLATIQALGKDPAIGLPVACAIEMIHTYSLIHDDLPSMDNDDLRRGKPTNHKVFGEAMAILAGDALLTYAFQLIAEVDDDRVPPSVRLQLIEQLAKAAGPEGMVAGQAADMEAEGKTLALAELEYIHRHGTGKMLQYSVHAGALLGGADGRQTRELNEFAAHLGLAFQIRDDILDIEGMEEKIGKRVGSDRDNKKATYPVLLSLGGAKEKLAFHIDAAKRHLQQAKIDDAVLAYICELVAVRDH

SEQ ID NO: 30 - protein, 352 aa, Saccharomyces cerevisiae; identical to SEQ ID NO: 7

SEQ ID NO: 31 - protein, 347 aa, Neosartorya fumigata
MATTTSRAAFEAVFPTLAEDLLAHAKKYNLPENAVKWFEQVLNVNVPGGKLNRGLSVPDTGIALLQKPLTDEQFKHLSILGWLTELLQAFFLVSDDMMDSSITRRGQPCWYRHPGVGLIAINDAFMLESGIYVILKKHFRSHPAYVDFLELFHETTWQTELGQLCDLITAPEDKVDLDNFSMEKYMFIVTYGTAYYSFYLPVALALLYLELATPENLQQTHDILIPLGQYFQVQDDYLDAYGDPAVIGKIGTDIQDNKCSWLINQALQRCNTEQRKLLDTAYGRKDSELEAKVKALYKELDLEKVYKEYEEKTVGEIRRKIAAIDESQGLKKEVFEAFLGKIYKRTK

SEQ ID NO: 32 - protein, 347 aa, Neosartorya fumigata
MATTTSRAAFEAVFPTLAEDLLAHAKKYNLPENAVKWFEQVLNVNVPGGKLNRGLSVPDTGIALLQKPLTDEQFKHLSILGWLTELLQAFWLVSDDMMDSSITRRGQPCWYRHPGVGLIAIWDAFMLESGIYVILKKHFRSHPAYVDFLELFHETTWQTELGQLCDLITAPEDKVDLDNFSMEKYMFIVTYKTAYYSFYLPVALALLYLELATPENLQQTHDILIPLGQYFQVQDDYLDAYGDPAVIGKIGTDIQDNKCSWLINQALQRCNTEQRKLLDTAYGRKDSELEAKVKALYKELDLEKVYKEYEEKTVGEIRRKIAAIDESQGLKKEVFEAFLGKIYKRTK

SEQ ID NO: 33 - protein, 365 aa, Catharanthus roseus
MCVSSALANVGQQVQRQSNSVAEEPLDPFSLVADELSILANRLRSMVVAEVPKLASAAEYFFKLGVEGKRFRPTVLLLMATAIDAPISRTPPDTSLDTLSTELRLRQQSIAEITEMIHVASLLHDDVLDDAETRRGIGSLNFVMGNKLAVLAGDFLLSRACVALASLKNTEVVSLLATVVEHLVTGETMQMTTTSDQRCSMEYYMQKTYYGTASLISNSCKAIALLAGQTSEVAMLAYEYGKNLGLAFQLIDDVLDFTGTSASLGKGSLSDIRHGIVTAPILFAIEEFPELRAVVDEGFENPYNVDLALHYLGKSRGIQRTRELAIKHANLASDAIDSLPVTDDEHVLRSRRALVELTQRVITRR

SEQ ID NO: 34 - protein, 304 aa, Rhizobium acidisoli
MDANRDTFETRLKNNAREIEALLDALLLPNALSDEIARPETLRSAMHYAVLNGGKRLRPFLVVESAALLGGDDEAARRVGAALECVHCYSLVHDDLPAMDDDDLRRGKPTVHIKFDEATAILAGDSLLTYAFDIIAAPETALADTSKASLVLALARAAGLGGMAGGQALDLAAEKQAPDEAGIIRLQAMGTGALIRFACEAGALIAASPPEDRRRLRAFGEKIGLAFQLADDILDLTSDTATMGKATGKDAARGKGTLVALHGIEWAEEQLRQHVRDAEALLAPYGARASTLIAAAHFIADRKS

SEQ ID NO: 35 - protein, 299 aa, Escherichia coli; identical to SEQ ID NO: 14

SEQ ID NO: 36 - protein, 304 aa, Brucella suis
MEKLPVDFTTLLNRRAMEVEAALAGLLDECPRTGEIARPQRLIAAMRHGVLNGGKRLRPFLVLESAALFGQYGQAVLRVAAALECIHCYSLVHDDLPAMDDDDLRRGQPTVHKAFDEAAAILAGDSLLTYAFDIIASDETELDATTRIKLVCALTRASGLGGMAGGQALDLMAETRKPDEAGIITLQAMGTGALIRFACEAGAIIAGASQEDRERMAEFGSAIGLAFQLADDLLDVTADAGTMGKATGKDAAAGKATLVSLHGIDWTRQQLSGLVAQAESLLAPFGEDAEPLKQAARFIAERQN

SEQ ID NO: 37 - protein, 339 aa, Arabidopsis thaliana
MFSLVADELSLLSNKLREMVLAEVPKLASAAEYFFKRGVQGKQFRSTILLLMATALNVRVPEALIGESTDIVTSELRVRQRGIAEITEMIHVASLLHDDVLDDADTRRGVGSLNVVMGNKMSVLAGDFLLSRACGALAALKNTEVVALLATAVEHLVTGETMEITSSTEQRYSMDYYMQKTYYGTASLISNSCKAVAVLTGQTAEVAVLAFEYGRNLGLAFQLIDDILDFTGTSASLGKGSLSDIRHGVITAPILFAMEEFPQLREVVDQVEKDPRNVDIALEYLGKSKGIQRARELAMEHANLAAAAIGSLPETDNEDVKRSRRALIDLTHRVITRNK

SEQ ID NO: 38 - protein, 282 aa, Buchnera aphidicola
MHFFHLYERYKHRINQKLFYTLNQLPFQKSSLLKAMKYSVFSGSKRLRSSLIYSTGDVFKVNITTLDVISTAIEFIHSYSLIHDDLPCMDNDNFRRGKISCHVKYGESTSLLAGDALQSLAFNILSNSFMPNVSNLKRIKMISELSYSIGSSGMCMGQNLDLEAEKKDVNLSELEIINLYGTSFLMRSAVRLVYFSSNNFSKSILSILDLFSISIGLAFQIQDDILDFKKDSVKTDNKKIIKKHTYPLIIGLDESRKKIKQLHKKSFLALNSLKKKISIPTY

SEQ ID NO: 39 - protein, 355 aa, Dendroctonus ponderosae
MIRPVQSSALVTKEQSRDFMALFPDLVRELTEVGKSQELPDVMRRFARVLQYNTPTGKKNRGLIVLSTYRMLEDPEKLTPENIRLASILGWCVEMVHAYFLILDDIMDGSETRRGALCWFRQSGIGLTAVNDAVMIENAVYLLIKRHLKDHPMYVPLMELFHEGNLKTTLGQSLDAMCLDTNGKPKLDMFTMSRYTSIVKYGTAFYSFQMPVAIAMYLAGMSDEEQHRQAKTILMEMGQFFQIQDDFLDCFGDPTVTGKVGTDIQDGKCSWLAVVALQRASPAQRKIMEEHYGRPEPESIARIKNLYVDLCLPNTYAIYEEESFNIIKTHIQQISKGLRHDLFFKIMEKIYKREC

SEQ ID NO: 40 - protein, 314 aa, Picea abies
MKALVQLADLSEQVKNVVEFDFDKYMHSKAIAVNEALDKVIPPRYPQKIYESMRYSLLAGGKRVRPILCIAACELMGGTEELAMPTACAIEMIHTMSLIHDDLPYIDNDDLRRGKPTNHKVFGEDTAIIAGDALLSLAFEHVAVSTSRTLGTDIILRLLSEIGRATGSEGVMGGQVVDIESEGDPSIDLETLEWVHIHGTAVLLECSVVCGAIMGGASEDDIERARRYARCVGLLFQVVDDILDVSQSSEELGKTAGKDLISDKATYPKLMGLEKAKEFADELLNRGKQELSCFDPTKAAPLFALADYIASRQN

SEQ ID NO: 41 - protein, 300 aa, Abies grandis
MKAVEFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHGTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 42 - protein, 371 aa, Corynebacterium glutamicum
MKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFGTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 43 - protein, 347 aa, Vitis vinifera
MLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYGTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 44 - protein, 319 aa, Picea abies
MLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 45 - protein, 319 aa, Picea abies
MLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPPMDNDDFRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 46 - protein, 319 aa, Picea abies
MLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPPMDNDDLRRGKPTNHKVFGEGTAVLAGDALLSFAFEHIAVSTSKTVESDRVLRVVSELGRAIGSEGVAGGQVADITSQGNPSVGLETLEWIHIHGTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 47 - protein, 319 aa, Picea abies
MLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPPMDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLFECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 48 - protein, 319 aa, Picea abies
MLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPPMDNDDLRRGKPTNHKVFGEGTAVLAGDALLSFAFEHIAVSTSKTVESDRVLRVVSELGRATGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 49 - protein, 353 aa, Sus scrofa
MNGDQKLDAYARERQDFIQHFSQIVKVLTEEDIGHPEIGDAVARLKEVLEYNVVGGKYNRGITVLVVFRELVEPRKQDADSLQRALTVGWCIELLQAFFLVADDIEDSSLTRRGQTCWYRKPGIGLDAINDAFLLEACIYRLLKFYCREQPYYLNLIELFLQTSYNTEIGQTLDLIAGPQGNVDLSRFTEKRYKSIVKYGTAFYSFYLPVAAAMYMAGIDGEKEHANAKKILMEMGEFFQIQDDYLDLFGDPSVTGKIGTDIQDNKCSWLVVQCLQRASPEQRQILQENYGQKDAEKVARVKALYEEMNLQAVFLQYEEDSYSHLMGLIEQYAAPLPPAIFLELAHKIYKRRK

SEQ ID NO: 50 - protein, 353 aa, Acyrthosiphon pisum
MPVITGTAVSKDETRDFMAVFPDVVRDLTDTGRNLDVPDVTKWLAKLLQYNVPGGKKNRGLALVLSYKMLSSPADQTDENIRLSYILGWCVEILQAYQLVLDDIMDNAITRRGRPCWYRHNDIGLMAVNDGVLLEQSIYQLIKKYFKDKPYYTHILELFYDVTMKTSMGQCLDMLTANSFKSKKLEKYTMENYTAIVKYGTAYYSFFLPVCLAMRMTNINDPEIFRQAKTILLEMGHFFQVQDDFLDCYGDPDVMGKIGTDIEDGKCSWLAVVALQKVNSEQKKIMEDNYGIDNPANVAVIKDLYAQLKLPDTFHLYEEESYKLICTHIQQLSRGLSQDMFFKFLEKIYKRTL

SEQ ID NO: 51 - protein, 359 aa, Mycobacterium tuberculosis
MRGTDEKYGLPPQPDSDRMTRRTLPVLGLAHELITPTLRQMADRLDPHMRPVVSYHLGWSDERGRPVNNNCGKAIRPALVFVAAEAAGADPHSAIPGAVSVELVHNFSLVHDDLMDRDEHRRHRPTVWALWGDAMALLAGDAMLSLAHEVLLDCDSPHVGAALRAISEATRELIRGQAADTAFESRTDVALDECLKMAEGGTAALMAASAEVGALLAGAPRSVREALVAYGRHIGLAFQLVDDLLGIWGRPEITGKPVYSDLRSRKKTLPVTWTVAHGGLAGRRLAAWLVDETGSQTASDDELAAVAELIECGGGRRWASAEARRHVTQGIDMVARIGIPDRPAAELQDLAHYIVDRQA

SEQ ID NO: 52 - protein, 293 aa, Staphylococcus aureus
MTNLPMNKLIDEVNNELSVAINKSVMDTQLEESMLYSLNAGGKRIRPVLLLLTLDSLNTEYELGMKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTGTGALLTFAVMSAADIANVDDTTKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 53 - protein, 297 aa, Geobacillus sp.
MAQLSVEQFLNEQKRAVEAALSSYMARLRGPETLKKAMAYSLEAGGKRIRPLLLLATIQALGKDPAIGLPVACAIEMIHTYFLIHDDLPCIDNDDLRRGKPTNHKVFGEAMAILAGDALLTYAFQLIAEVDDDRVPPSVRLQLIEQLAKAAGPEGMVAGQAADMEAEGKTLALAELEYIHRHKTGKMLQYSVHAGALLGGADGRQTRELNEFAAHLGLAFQIRDDILDIEGMEEKIGKRVGSDRDNKKATYPVLLSLGGAKEKLAFHIDAAKRHLQQAKIDDAVLAYICELVAVRDH

SEQ ID NO: 54 - protein, 297 aa, Geobacillus sp.
MAQLSVEQFLNEQKRAVEAALSSYMARLRGPETLKKAMAYSLEAGGKRIRPLLLLATIQALGKDPAIGLPVACAIEMIHTYSLIHDDLPCIDNDDLRRGKPTNHKVFGEAMAILAGDALLTYAFQLIAEVDDDRVPPSVRLQLIEQLAKAAGPEGMVAGQAADMEAEGKTLALAELEYIHRHKTGKMLQYSVHAGALLGGADGRQTRELNEFAAHLGLAFQIRDDILDIEGMEEKIGKRVGSDRDNKKATYPVLLSLGGAKEKLAFHIDAAKRHLQQAKIDDAVLAYICELVAVRDH

SEQ ID NO: 55 - protein, 297 aa, Geobacillus sp.
MAQLSVEQFLNEQKRAVEAALSSYMARLRGPETLKKAMAYSLEAGGKRIRPLLLLATIQALGKDPAIGLPVACAIEMIHTYSLIHDDLPSMDNDDFRRGKPTNHKVFGEAMAILAGDALLTYAFQLIAEVDDDRVPPSVRLQLIEQLAKAAGPEGMVAGQAADMEAEGKTLALAELEYIHRHKTGKMLQYSVHAGALLGGADGRQTRELNEFAAHLGLAFQIRDDILDIEGMEEKIGKRVGSDRDNKKATYPVLLSLGGAKEKLAFHIDAAKRHLQQAKIDDAVLAYICELVAVRDH

SEQ ID NO: 56 - protein, 297 aa, Geobacillus sp.
MAQLSVEQFLNEQKRAVEAALSSYMARLRGPETLKKAMAYSLEAGGKRIRPLLLLATIQALGKDPAIGLPVACAIEMIHTYSLIHDDLPSMDNDDLRRGKPTNHKVFGEAMAILAGDALLTYAFQLIAEVDDDRVPPSVRLQLIEQLAKAAGPEGMVAGQAADMEAEGKTLALAELEYIHRHKTGKMFQYSVHAGALLGGADGRQTRELNEFAAHLGLAFQIRDDILDIEGMEEKIGKRVGSDRDNKKATYPVLLSLGGAKEKLAFHIDAAKRHLQQAKIDDAVLAYICELVAVRDH

SEQ ID NO: 57 - protein, 304 aa, Rhizobium acidisoli
MDANRDTFETRLKNNAREIEALLDALLLPNALSDEIARPETLRSAMHYAVLNGGKRLRPFLVVESAALLGGDDEAARRVGAALECVHCYFLVHDDLPCIDDDDLRRGKPTVHIKFDEATAILAGDSLLTYAFDIIAAPETALADTSKASLVLALARAAGLGGMAGGQALDLAAEKQAPDEAGIIRLQAMKTGALIRFACEAGALIAASPPEDRRRLRAFGEKIGLAFQLADDILDLTSDTATMGKATGKDAARGKGTLVALHGIEWAEEQLRQHVRDAEALLAPYGARASTLIAAAHFIADRKS

SEQ ID NO: 58 - protein, 304 aa, Rhizobium acidisoli
MDANRDTFETRLKNNAREIEALLDALLLPNALSDEIARPETLRSAMHYAVLNGGKRLRPFLVVESAALLGGDDEAARRVGAALECVHCYSLVHDDLPAMDDDDFRRGKPTVHIKFDEATAILAGDSLLTYAFDIIAAPETALADTSKASLVLALARAAGLGGMAGGQALDLAAEKQAPDEAGIIRLQAMKTGALIRFACEAGALIAASPPEDRRRLRAFGEKIGLAFQLADDILDLTSDTATMGKATGKDAARGKGTLVALHGIEWAEEQLRQHVRDAEALLAPYGARASTLIAAAHFIADRKS

SEQ ID NO: 59 - protein, 304 aa, Rhizobium acidisoli
MDANRDTFETRLKNNAREIEALLDALLLPNALSDEIARPETLRSAMHYAVLNGGKRLRPFLVVESAALLGGDDEAARRVGAALECVHCYSLVHDDLPCIDDDDLRRGKPTVHIKFDEATAILAGDSLLTYAFDIIAAPETALADTSKASLVLALARAAGLGGMAGGQALDLAAEKQAPDEAGIIRLQAMKTGALIRFACEAGALIAASPPEDRRRLRAFGEKIGLAFQLADDILDLTSDTATMGKATGKDAARGKGTLVALHGIEWAEEQLRQHVRDAEALLAPYGARASTLIAAAHFIADRKS

SEQ ID NO: 60 - protein, 299 aa, Escherichia coli
MDFPQQLEACVKQANQALSRFIAPLPFQNTPVVETMQYGALLGGKRLRPFLVYATGHMFGVSTNTLDAPAAAVECIHAYFLIHDDLPCIDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 61 - protein, 299 aa, Escherichia coli
MDFPQQLEACVKQANQALSRFIAPLPFQNTPVVETMQYGALLGGKRLRPFLVYATGHMFGVSTNTLDAPAAAVECIHAYSLIHDDLPAMDDDDFRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 62 - protein, 299 aa, Escherichia coli
MDFPQQLEACVKQANQALSRFIAPLPFQNTPVVETMQYGALLGGKRLRPFLVYATGHMFGVSTNTLDAPAAAVECIHAYSLIHDDLPCIDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 63 - protein, 304 aa, Brucella suis
MEKLPVDFTTLLNRRAMEVEAALAGLLDECPRTGEIARPQRLIAAMRHGVLNGGKRLRPFLVLESAALFGQYGQAVLRVAAALECIHCYFLVHDDLPCIDDDDLRRGQPTVHKAFDEAAAILAGDSLLTYAFDIIASDETELDATTRIKLVCALTRASGLGGMAGGQALDLMAETRKPDEAGIITLQAMKTGALIRFACEAGAIIAGASQEDRERMAEFGSAIGLAFQLADDLLDVTADAGTMGKATGKDAAAGKATLVSLHGIDWTRQQLSGLVAQAESLLAPFGEDAEPLKQAARFIAERQN

SEQ ID NO: 64 - protein, 304 aa, Brucella suis
MEKLPVDFTTLLNRRAMEVEAALAGLLDECPRTGEIARPQRLIAAMRHGVLNGGKRLRPFLVLESAALFGQYGQAVLRVAAALECIHCYSLVHDDLPCIDDDDLRRGQPTVHKAFDEAAAILAGDSLLTYAFDIIASDETELDATTRIKLVCALTRASGLGGMAGGQALDLMAETRKPDEAGIITLQAMKTGALIRFACEAGAIIAGASQEDRERMAEFGSAIGLAFQLADDLLDVTADAGTMGKATGKDAAAGKATLVSLHGIDWTRQQLSGLVAQAESLLAPFGEDAEPLKQAARFIAERQN

SEQ ID NO: 65 - protein, 282 aa, Buchnera aphidicola
MHFFHLYERYKHRINQKLFYTLNQLPFQKSSLLKAMKYSVFSGSKRLRSSLIYSTGDVFKVNITTLDVISTAIEFIHSYFLIHDDLPCIDNDNFRRGKISCHVKYGESTSLLAGDALQSLAFNILSNSFMPNVSNLKRIKMISELSYSIGSSGMCMGQNLDLEAEKKDVNLSELEIINLYKTSFLMRSAVRLVYFSSNNFSKSILSILDLFSISIGLAFQIQDDILDFKKDSVKTDNKKIIKKHTYPLIIGLDESRKKIKQLHKKSFLALNSLKKKISIPTY

SEQ ID NO: 66 - protein, 282 aa, Buchnera aphidicola; identical to SEQ ID NO: 65

SEQ ID NO: 67 - protein, 282 aa, Buchnera aphidicola
MHFFHLYERYKHRINQKLFYTLNQLPFQKSSLLKAMKYSVFSGSKRLRSSLIYSTGDVFKVNITTLDVISTAIEFIHSYSLIHDDLPCMDNDNFRRGKISCHVKYGESTSLLAGDALQSLAFNILSNSFMPNVSNLKRIKMISELSYSTGSSGMCMGQNLDLEAEKKDVNLSELEIINLYKTSFLMRSAVRLVYFSSNNFSKSILSILDLFSISIGLAFQIQDDILDFKKDSVKTDNKKIIKKHTYPLIIGLDESRKKIKQLHKKSFLALNSLKKKISIPTY

SEQ ID NO: 68 - protein, 355 aa, Dendroctonus ponderosae
MIRPVQSSALVTKEQSRDFMALFPDLVRELTEVGKSQELPDVMRRFARVLQYNTPTGKKNRGLIVLSTYRMLEDPEKLTPENIRLASILGWCVEMVHAYWLILDDIMDGSETRRGALCWFRQSGIGLTAVWDAVMIENAVYLLIKRHLKDHPMYVPLMELFHEGNLKTTLGQSLDAMCLDTNGKPKLDMFTMSRYTSIVKYKTAFYSFQMPVAIAMYLAGMSDEEQHRQAKTILMEMGQFFQIQDDFLDCFGDPTVTGKVGTDIQDGKCSWLAVVALQRASPAQRKIMEEHYGRPEPESIARIKNLYVDLCLPNTYAIYEEESFNIIKTHIQQISKGLRHDLFFKIMEKIYKREC

SEQ ID NO: 69 - protein, 314 aa, Picea abies
MKALVQLADLSEQVKNVVEFDFDKYMHSKAIAVNEALDKVIPPRYPQKIYESMRYSLLAGGKRVRPILCIAACELMGGTEELAMPTACAIEMIHTISLIHDDLPYIDNDDLRRGKPTNHKVFGEDTAIIAGDALLSLAFEHVAVSTSRTLGTDIILRLLSEIGRATGSEGVMGGQVVDIESEGDPSIDLETLEWVHIHKTAVLLECSVVCGAIMGGASEDDIERARRYARCVGLLFQVVDDILDVSQSSEELGKTAGKDLISDKATYPKLMGLEKAKEFADELLNRGKQELSCFDPTKAAPLFALADYIASRQN

SEQ ID NO: 70 - protein, 314 aa, Picea abies
MKALVQLADLSEQVKNVVEFDFDKYMHSKAIAVNEALDKVIPPRYPQKIYESMRYSLLAGGKRVRPILCIAACELMGGTEELAMPTACAIEMIHTMSLIHDDLPYIDNDDFRRGKPTNHKVFGEDTAIIAGDALLSLAFEHVAVSTSRTLGTDIILRLLSEIGRATGSEGVMGGQVVDIESEGDPSIDLETLEWVHIHKTAVLLECSVVCGAIMGGASEDDIERARRYARCVGLLFQVVDDILDVSQSSEELGKTAGKDLISDKATYPKLMGLEKAKEFADELLNRGKQELSCFDPTKAAPLFALADYIASRQN

SEQ ID NO: 71 - protein, 314 aa, Picea abies
MKALVQLADLSEQVKNVVEFDFDKYMHSKAIAVNEALDKVIPPRYPQKIYESMRYSLLAGGKRVRPILCIAACELMGGTEELAMPTACAIEMIHTMSLIHDDLPYIDNDDLRRGKPTNHKVFGEDTAIIAGDALLSLAFEHVAVSTSRTLGTDIILRLLSEIGRATGSEGVMGGQVVDIESEGDPSIDLETLEWVHIHKTAVLFECSVVCGAIMGGASEDDIERARRYARCVGLLFQVVDDILDVSQSSEELGKTAGKDLISDKATYPKLMGLEKAKEFADELLNRGKQELSCFDPTKAAPLFALADYIASRQN

SEQ ID NO: 72 - protein, 300 aa, Abies grandis
MKAVEFDFNKYMDSKAMTVNEALNKAIPLRYPQKIYESMRYSLLAGGKRVRPVLCIAACELVGGTEELAIPTACAIEMIHTISLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 73 - protein, 300 aa, Abies grandis
MKAVEFDFNKYMDSKAMTVNEALNKAIPLRYPQKIYESMRYSLLAGGKRVRPVLCIAACELVGGTEELAIPTACAIEMIHTMSLMHDDLPCIDNDDFRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 74 - protein, 300 aa, Abies grandis
MKAVEFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLFECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 75 - protein, 319 aa, Picea abies
MLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMFLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 76 - protein, 319 aa, Picea abies; identical to SEQ ID NO: 44

SEQ ID NO: 77 - protein, 319 aa, Picea abies; identical to SEQ ID NO: 45

SEQ ID NO: 78 - protein, 353 aa, Sus scrofa
MNGDQKLDAYARERQDFIQHFSQIVKVLTEEDIGHPEIGDAVARLKEVLEYNVVGGKYNRGITVLVVFRELVEPRKQDADSLQRALTVGWCIELLQAFWLVADDIEDSSLTRRGQTCWYRKPGIGLDAIWDAFLLEACIYRLLKFYCREQPYYLNLIELFLQTSYNTEIGQTLDLIAGPQGNVDLSRFTEKRYKSIVKYKTAFYSFYLPVAAAMYMAGIDGEKEHANAKKILMEMGEFFQIQDDYLDLFGDPSVTGKIGTDIQDNKCSWLVVQCLQRASPEQRQILQENYGQKDAEKVARVKALYEEMNLQAVFLQYEEDSYSHLMGLIEQYAAPLPPAIFLELAHKIYKRRK

SEQ ID NO: 79 - protein, 293 aa, Staphylococcus aureus
MTNLPMNKLIDEVNNELSVAINKSVMDTQLEESMLYSLNAGGKRIRPVLLLLTLDSLNTEYELGMKSAIALEMIHTYFLIHDDLPCIDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDTTKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 80 - protein, 293 aa, Staphylococcus aureus
MTNLPMNKLIDEVNNELSVAINKSVMDTQLEESMLYSLNAGGKRIRPVLLLLTLDSLNTEYELGMKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALFTFAVMSAADIANVDDTTKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 81 - protein, 293 aa, Staphylococcus aureus
MTNLPMNKLIDEVNNELSVAINKSVMDTQLEESMLYSLNAGGKRIRPVLLLLTLDSLNTEYELGMKSAIALEMIHTYSLIHDDLPCIDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDTTKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 82 - protein, 297 aa, Geobacillus sp.
MAQLSVEQFLNEQKRAVEAALSSYMARLRGPETLKKAMAYSLEAGGKRIRPLLLLATIQALGKDPAIGLPVACAIEMIHTYFLIHDDLPSMDNDDLRRGKPTNHKVFGEAMAILAGDALLTYAFQLIAEVDDDRVPPSVRLQLIEQLAKAAGPEGMVAGQAADMEAEGKTLALAELEYIHRHKTGKMLQYSVHAGALLGGADGRQTRELNEFAAHLGLAFQIRDDILDIEGMEEKIGKRVGSDRDNKKATYPVLLSLGGAKEKLAFHIDAAKRHLQQAKIDDAVLAYICELVAVRDH

SEQ ID NO: 83 - protein, 354 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMPCIDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 84 - protein, 349 aa, Neosartorya fumigata
MATTTSRAAFEAVFPTLAEDLLAHAKKYNLPENAVKWFEQVLNVNVPGGKLNRGLSVPDTGIALLQKPLTDEQFKHLSILGWLTELLQAFFLVSDDMPCIDSSITRRGQPCWYRHPGVGLIAINDAFMLESGIYVILKKHFRSHPAYVDFLELFHETTWQTELGQLCDLITAPEDKVDLDNFSMEKYMFIVTYKTAYYSFYLPVALALLYLELATPENLQQTHDILIPLGQYFQVQDDYLDAYGDPAVIGKIGTDIQDNKCSWLINQALQRCNTEQRKLLDTAYGRKDSELEAKVKALYKELDLEKVYKEYEEKTVGEIRRKIAAIDESQGLKKEVFEAFLGKIYKRTK

SEQ ID NO: 85 - protein, 365 aa, Catharanthus roseus
MCVSSALANVGQQVQRQSNSVAEEPLDPFSLVADELSILANRLRSMVVAEVPKLASAAEYFFKLGVEGKRFRPTVLLLMATAIDAPISRTPPDTSLDTLSTELRLRQQSIAEITEMIHVAFLLHDDVLDDAETRRGIGSLNFVMGNKLAVLAGDFLLSRACVALASLKNTEVVSLLATVVEHLVTGETMQMTTTSDQRCSMEYYMQKTYYKTASLISNSCKAIALLAGQTSEVAMLAYEYGKNLGLAFQLIDDVLDFTGTSASLGKGSLSDIRHGIVTAPILFAIEEFPELRAVVDEGFENPYNVDLALHYLGKSRGIQRTRELAIKHANLASDAIDSLPVTDDEHVLRSRRALVELTQRVITRR

SEQ ID NO: 86 - protein, 367 aa, Catharanthus roseus
MCVSSALANVGQQVQRQSNSVAEEPLDPFSLVADELSILANRLRSMVVAEVPKLASAAEYFFKLGVEGKRFRPTVLLLMATAIDAPISRTPPDTSLDTLSTELRLRQQSIAEITEMIHVAFLLHDDVPCIDDAETRRGIGSLNFVMGNKLAVLAGDFLLSRACVALASLKNTEVVSLLATVVEHLVTGETMQMTTTSDQRCSMEYYMQKTYYKTASLISNSCKAIALLAGQTSEVAMLAYEYGKNLGLAFQLIDDVLDFTGTSASLGKGSLSDIRHGIVTAPILFAIEEFPELRAVVDEGFENPYNVDLALHYLGKSRGIQRTRELAIKHANLASDAIDSLPVTDDEHVLRSRRALVELTQRVITRR

SEQ ID NO: 87 - protein, 367 aa, Catharanthus roseus
MCVSSALANVGQQVQRQSNSVAEEPLDPFSLVADELSILANRLRSMVVAEVPKLASAAEYFFKLGVEGKRFRPTVLLLMATAIDAPISRTPPDTSLDTLSTELRLRQQSIAEITEMIHVASLLHDDVPCIDDAETRRGIGSLNFVMGNKLAVLAGDFLLSRACVALASLKNTEVVSLLATVVEHLVTGETMQMTTTSDQRCSMEYYMQKTYYKTASLISNSCKAIALLAGQTSEVAMLAYEYGKNLGLAFQLIDDVLDFTGTSASLGKGSLSDIRHGIVTAPILFAIEEFPELRAVVDEGFENPYNVDLALHYLGKSRGIQRTRELAIKHANLASDAIDSLPVTDDEHVLRSRRALVELTQRVITRR

SEQ ID NO: 88 - protein, 304 aa, Rhizobium acidisoli
MDANRDTFETRLKNNAREIEALLDALLLPNALSDEIARPETLRSAMHYAVLNGGKRLRPFLVVESAALLGGDDEAARRVGAALECVHCYFLVHDDLPAMDDDDLRRGKPTVHIKFDEATAILAGDSLLTYAFDIIAAPETALADTSKASLVLALARAAGLGGMAGGQALDLAAEKQAPDEAGIIRLQAMKTGALIRFACEAGALIAASPPEDRRRLRAFGEKIGLAFQLADDILDLTSDTATMGKATGKDAARGKGTLVALHGIEWAEEQLRQHVRDAEALLAPYGARASTLIAAAHFIADRKS

SEQ ID NO: 89 - protein, 299 aa, Escherichia coli; identical to SEQ ID NO: 13

SEQ ID NO: 90 - protein, 304 aa, Brucella suis
MEKLPVDFTTLLNRRAMEVEAALAGLLDECPRTGEIARPQRLIAAMRHGVLNGGKRLRPFLVLESAALFGQYGQAVLRVAAALECIHCYFLVHDDLPAMDDDDLRRGQPTVHKAFDEAAAILAGDSLLTYAFDIIASDETELDATTRIKLVCALTRASGLGGMAGGQALDLMAETRKPDEAGIITLQAMKTGALIRFACEAGAIIAGASQEDRERMAEFGSAIGLAFQLADDLLDVTADAGTMGKATGKDAAAGKATLVSLHGIDWTRQQLSGLVAQAESLLAPFGEDAEPLKQAARFIAERQN

SEQ ID NO: 91 - protein, 339 aa, Arabidopsis thaliana
MFSLVADELSLLSNKLREMVLAEVPKLASAAEYFFKRGVQGKQFRSTILLLMATALNVRVPEALIGESTDIVTSELRVRQRGIAEITEMIHVAFLLHDDVLDDADTRRGVGSLNVVMGNKMSVLAGDFLLSRACGALAALKNTEVVALLATAVEHLVTGETMEITSSTEQRYSMDYYMQKTYYKTASLISNSCKAVAVLTGQTAEVAVLAFEYGRNLGLAFQLIDDILDFTGTSASLGKGSLSDIRHGVITAPILFAMEEFPQLREVVDQVEKDPRNVDIALEYLGKSKGIQRARELAMEHANLAAAAIGSLPETDNEDVKRSRRALIDLTHRVITRNK

SEQ ID NO: 92 - protein, 341 aa, Arabidopsis thaliana
MFSLVADELSLLSNKLREMVLAEVPKLASAAEYFFKRGVQGKQFRSTILLLMATALNVRVPEALIGESTDIVTSELRVRQRGIAEITEMIHVAFLLHDDVPCIDDADTRRGVGSLNVVMGNKMSVLAGDFLLSRACGALAALKNTEVVALLATAVEHLVTGETMEITSSTEQRYSMDYYMQKTYYKTASLISNSCKAVAVLTGQTAEVAVLAFEYGRNLGLAFQLIDDILDFTGTSASLGKGSLSDIRHGVITAPILFAMEEFPQLREVVDQVEKDPRNVDIALEYLGKSKGIQRARELAMEHANLAAAAIGSLPETDNEDVKRSRRALIDLTHRVITRNK

SEQ ID NO: 93 - protein, 341 aa, Arabidopsis thaliana
MFSLVADELSLLSNKLREMVLAEVPKLASAAEYFFKRGVQGKQFRSTILLLMATALNVRVPEALIGESTDIVTSELRVRQRGIAEITEMIHVASLLHDDVPCIDDADTRRGVGSLNVVMGNKMSVLAGDFLLSRACGALAALKNTEVVALLATAVEHLVTGETMEITSSTEQRYSMDYYMQKTYYKTASLISNSCKAVAVLTGQTAEVAVLAFEYGRNLGLAFQLIDDILDFTGTSASLGKGSLSDIRHGVITAPILFAMEEFPQLREVVDQVEKDPRNVDIALEYLGKSKGIQRARELAMEHANLAAAAIGSLPETDNEDVKRSRRALIDLTHRVITRNK

SEQ ID NO: 94 - protein, 282 aa, Buchnera aphidicola
MHFFHLYERYKHRINQKLFYTLNQLPFQKSSLLKAMKYSVFSGSKRLRSSLIYSTGDVFKVNITTLDVISTAIEFIHSYFLIHDDLPCMDNDNFRRGKISCHVKYGESTSLLAGDALQSLAFNILSNSFMPNVSNLKRIKMISELSYSIGSSGMCMGQNLDLEAEKKDVNLSELEIINLYKTSFLMRSAVRLVYFSSNNFSKSILSILDLFSISIGLAFQIQDDILDFKKDSVKTDNKKIIKKHTYPLIIGLDESRKKIKQLHKKSFLALNSLKKKISIPTY

SEQ ID NO: 95 - protein, 357 aa, Dendroctonus ponderosae
MIRPVQSSALVTKEQSRDFMALFPDLVRELTEVGKSQELPDVMRRFARVLQYNTPTGKKNRGLIVLSTYRMLEDPEKLTPENIRLASILGWCVEMVHAYFLILDDIPCIDGSETRRGALCWFRQSGIGLTAVNDAVMIENAVYLLIKRHLKDHPMYVPLMELFHEGNLKTTLGQSLDAMCLDTNGKPKLDMFTMSRYTSIVKYKTAFYSFQMPVAIAMYLAGMSDEEQHRQAKTILMEMGQFFQIQDDFLDCFGDPTVTGKVGTDIQDGKCSWLAVVALQRASPAQRKIMEEHYGRPEPESIARIKNLYVDLCLPNTYAIYEEESFNIIKTHIQQISKGLRHDLFFKIMEKIYKREC

SEQ ID NO: 96 - protein, 314 aa, Picea abies
MKALVQLADLSEQVKNVVEFDFDKYMHSKAIAVNEALDKVIPPRYPQKIYESMRYSLLAGGKRVRPILCIAACELMGGTEELAMPTACAIEMIHTMFLIHDDLPYIDNDDLRRGKPTNHKVFGEDTAIIAGDALLSLAFEHVAVSTSRTLGTDIILRLLSEIGRATGSEGVMGGQVVDIESEGDPSIDLETLEWVHIHKTAVLLECSVVCGAIMGGASEDDIERARRYARCVGLLFQVVDDILDVSQSSEELGKTAGKDLISDKATYPKLMGLEKAKEFADELLNRGKQELSCFDPTKAAPLFALADYIASRQN

SEQ ID NO: 97 - protein, 300 aa, Abies grandis
MKAVEFDFNKYMDSKAMTVNEALNKAIPLRYPQKIYESMRYSLLAGGKRVRPVLCIAACELVGGTEELAIPTACAIEMIHTMFLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 98 - protein, 373 aa, Corynebacterium glutamicum
MKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIPCIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 99 - protein, 347 aa, Vitis vinifera
MLAEEQLDPFSLVADELSLLADRLRSMVVAEVPKLASAAEYFFKMGVEGKRFRPTVLLLMATALNVPLPRPALAEVPETLSTELRTRQQCIAEITEMIHVAFLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 100 - protein, 349 aa, Vitis vinifera
MLAEEQLDPFSLVADELSLLADRLRSMVVAEVPKLASAAEYFFKMGVEGKRFRPTVLLLMATALNVPLPRPALAEVPETLSTELRTRQQCIAEITEMIHVAFLLHDDVPCIDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 101 - protein, 349 aa, Vitis vinifera
MLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVPCIDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 102 - protein, 319 aa, Picea abies
MLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMFLIHDDLPPMDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 103 - protein, 355 aa, Sus scrofa
MNGDQKLDAYARERQDFIQHFSQIVKVLTEEDIGHPEIGDAVARLKEVLEYNVVGGKYNRGITVLVVFRELVEPRKQDADSLQRALTVGWCIELLQAFFLVADDIPCIDSSLTRRGQTCWYRKPGIGLDAINDAFLLEACIYRLLKFYCREQPYYLNLIELFLQTSYNTEIGQTLDLIAGPQGNVDLSRFTEKRYKSIVKYKTAFYSFYLPVAAAMYMAGIDGEKEHANAKKILMEMGEFFQIQDDYLDLFGDPSVTGKIGTDIQDNKCSWLVVQCLQRASPEQRQILQENYGQKDAEKVARVKALYEEMNLQAVFLQYEEDSYSHLMGLIEQYAAPLPPAIFLELAHKIYKRRK

SEQ ID NO: 104 - protein, 355 aa, Acyrthosiphon pisum
MPVITGTAVSKDETRDFMAVFPDVVRDLTDTGRNLDVPDVTKWLAKLLQYNVPGGKKNRGLALVLSYKMLSSPADQTDENIRLSYILGWCVEILQAYQLVLDDIPCIDNAITRRGRPCWYRHNDIGLMAVNDGVLLEQSIYQLIKKYFKDKPYYTHILELFYDVTMKTSMGQCLDMLTANSFKSKKLEKYTMENYTAIVKYKTAYYSFFLPVCLAMRMTNINDPEIFRQAKTILLEMGHFFQVQDDFLDCYGDPDVMGKIGTDIEDGKCSWLAVVALQKVNSEQKKIMEDNYGIDNPANVAVIKDLYAQLKLPDTFHLYEEESYKLICTHIQQLSRGLSQDMFFKFLEKIYKRTL

SEQ ID NO: 105 - protein, 359 aa, Mycobacterium tuberculosis
MRGTDEKYGLPPQPDSDRMTRRTLPVLGLAHELITPTLRQMADRLDPHMRPVVSYHLGWSDERGRPVNNNCGKAIRPALVFVAAEAAGADPHSAIPGAVSVELVHNFFLVHDDLMDRDEHRRHRPTVWALWGDAMALLAGDAMLSLAHEVLLDCDSPHVGAALRAISEATRELIRGQAADTAFESRTDVALDECLKMAEGKTAALMAASAEVGALLAGAPRSVREALVAYGRHIGLAFQLVDDLLGIWGRPEITGKPVYSDLRSRKKTLPVTWTVAHGGLAGRRLAAWLVDETGSQTASDDELAAVAELIECGGGRRWASAEARRHVTQGIDMVARIGIPDRPAAELQDLAHYIVDRQA

SEQ ID NO: 106 - protein, 361 aa, Mycobacterium tuberculosis
MRGTDEKYGLPPQPDSDRMTRRTLPVLGLAHELITPTLRQMADRLDPHMRPVVSYHLGWSDERGRPVNNNCGKAIRPALVFVAAEAAGADPHSAIPGAVSVELVHNFFLVHDDLPCIDRDEHRRHRPTVWALWGDAMALLAGDAMLSLAHEVLLDCDSPHVGAALRAISEATRELIRGQAADTAFESRTDVALDECLKMAEGKTAALMAASAEVGALLAGAPRSVREALVAYGRHIGLAFQLVDDLLGIWGRPEITGKPVYSDLRSRKKTLPVTWTVAHGGLAGRRLAAWLVDETGSQTASDDELAAVAELIECGGGRRWASAEARRHVTQGIDMVARIGIPDRPAAELQDLAHYIVDRQA

SEQ ID NO: 107 - protein, 361 aa, Mycobacterium tuberculosis
MRGTDEKYGLPPQPDSDRMTRRTLPVLGLAHELITPTLRQMADRLDPHMRPVVSYHLGWSDERGRPVNNNCGKAIRPALVFVAAEAAGADPHSAIPGAVSVELVHNFSLVHDDLPCIDRDEHRRHRPTVWALWGDAMALLAGDAMLSLAHEVLLDCDSPHVGAALRAISEATRELIRGQAADTAFESRTDVALDECLKMAEGKTAALMAASAEVGALLAGAPRSVREALVAYGRHIGLAFQLVDDLLGIWGRPEITGKPVYSDLRSRKKTLPVTWTVAHGGLAGRRLAAWLVDETGSQTASDDELAAVAELIECGGGRRWASAEARRHVTQGIDMVARIGIPDRPAAELQDLAHYIVDRQA

SEQ ID NO: 108 - protein, 293 aa, Staphylococcus aureus
MTNLPMNKLIDEVNNELSVAINKSVMDTQLEESMLYSLNAGGKRIRPVLLLLTLDSLNTEYELGMKSAIALEMIHTYFLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDTTKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 109 - protein, 297 aa, Picea abies; identical to SEQ ID NO: 5

SEQ ID NO: 110 - protein, 296 aa, Abies grandis; identical to SEQ ID NO: 3

SEQ ID NO: 111 - protein, 360 aa, Catharanthus roseus; identical to SEQ ID NO: 4

SEQ ID NO: 112 - protein, 297 aa, Picea abies; identical to SEQ ID NO: 5

SEQ ID NO: 113 - protein, 296 aa, Abies grandis; identical to SEQ ID NO: 3

SEQ ID NO: 114 - protein, 360 aa, Catharanthus roseus; identical to SEQ ID NO: 4

SEQ ID NO: 115 - protein, 351 aa, Abies grandis
MQYKLALNGKTLKGETTTEAVDAATAEKVFKQYANDNGVDGEWTYDDATKTFTVTEFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 116 - protein, 415 aa, Artificial Sequence
  source: /note="Description of Artificial Sequence: Synthetic polypeptide"
MQYKLALNGKTLKGETTTEAVDAATAEKVFKQYANDNGVDGEWTYDDATKTFTVTEANVGQQVQRQSNSVAEEPLDPFSLVADELSILANRLRSMVVAEVPKLASAAEYFFKLGVEGKRFRPTVLLLMATAIDAPISRTPPDTSLDTLSTELRLRQQTIAEITKMIHVASLLHDDVLDDAETRRGIGSLNFVMGNKLAVLAGDFLLSRACVALASLKNTEVVSLLATVVEHLVTGETMQMTTTSDQRCSMEYYMQKTYYMTASLISNSCKAIALLAGQTSEVAMLAYEYGKNLGLAFQLIDDVLDFTGTSASLGKGSLSDIRHGIVTAPILFAIEEFPELRAVVDEGFENPYNVDLALHYLGKSRGIQRTRELAIKHANLASDAIDSLPVTDDEHVLRSRRALVELTQRVITRRK

SEQ ID NO: 117 - protein, 352 aa, Picea abies
MQYKLALNGKTLKGETTTEAVDAATAEKVFKQYANDNGVDGEWTYDDATKTFTVTEEFDFDKYMHSKAIAVNEALDKVIPPRYPQKIYESMRYSLLAGGKRVRPILCIAACELMGGTEELAMPTACAIEMIHTMSLIHDDLPYIDNDDLRRGKPTNHKVFGEDTAIIAGDALLSLAFEHVAVSTSRTLGTDIILRLLSEIGRATGSEGVMGGQVVDIESEGDPSIDLETLEWVHIHKTAVLLECSVVCGAIMGGASEDDIERARRYARCVGLLFQVVDDILDVSQSSEELGKTAGKDLISDKATYPKLMGLEKAKEFADELLNRGKQELSCFDPTKAAPLFALADYIASRQN

SEQ ID NO: 118 - protein, 297 aa, Humulus lupulus
MSTFNFKSYMVQKANSVNQALDAAVLLREPQMIHEAMRYSLLAGGKRVRPVLCLSACELVGGDESVAMPAACAVEMIHTMSLIHDDLPCMDNDDLRRGKPTNHKVFGEDVAVLAGDALLAYAFEHVAVSTVGVPAARIIRAIGELAKSIGSEGLVAGQVVDIDSEGLANVGLEQLEFIHLHKTAALLEASVVLGAILGGGTDEQVEELRSFARCIGLLFQAVDDILDVTKSSQELGKTAGKDLVADKATYPRLMGIEKSREFAEKLNREAQEHLGGFDPQKAAPLIALANYIAYRQN

SEQ ID NO: 119 - protein, 261 aa, Humulus lupulus
MASITADIEAHLKQSITLKPPLSVHEPMYNLVFSAPPNSAPSLCVAACELVGGHRSKAIAAASALRLLHAANFTHEHLPLTDSPSPSPVIHNSYDPSIQLLMPDAILPLGFELLAQSYNPAQNNSDRVLRVIVEFARAFGSKGILDGQYRQRVVSISNGDEVDNAERVDCSGREKEGKMHACAAACGAILGDANEEETEKLRTFGLYVGMIQGYSIKFMREREEEKEAERTIKELRNLALKELEHFHGRKLEPISSFIYCL

SEQ ID NO: 120 - protein, 297 aa, Mentha x piperita
MPAFDFDGYMLRKAKSVNKALEAAVQMKEPLKIHESMRYSLLAGGKRVRPMLCIAACELVGGDESTAMPAACAVEMIHTMSLMHDDLPCMDNDDLRRGKPTNHMAFGESVAVLAGDALLSFAFEHVAAATKGAPPERIVRVLGELAVSIGSEGLVAGQVVDVCSEGMAEVGLDHLEFIHHHKTAALLQGSVVLGAILGGGKEEEVAKLRKFANCIGLLFQVVDDILDVTKSSKELGKTAGKDLVADKTTYPKLIGVEKSKEFADRLNREAQEQLLHFHPHRAAPLIALANYIAYRDN

SEQ ID NO: 121 - protein, 267 aa, Mentha x piperita
MSQPYWAAIEADIERYLKKSITIRPPETVFGPMHHLTFAAPATAASTLCLAACELVGGDRSQAMAAAAAIHLVHAAAYVHEHLPLTDGSRPVSKPAIQHKYGPNVELLTGDGIVPFGFELLAGSVDPARTDDPDRILRVIIEISRAGGPEGMISGLHREEEIVDGNTSLDFIEYVCKKKYGEMHACGAACGAILGGAAEEEIQKLRNFGLYQGTLRGMMEMKNSHQLIDENIIGKLKELALEELGGFHGKNAELMSSLVAEPSLYAA

SEQ ID NO: 122 - protein, 297 aa, Catharanthus roseus
MSSFDFKAYMIGKANSVNKALEDAVLVREPLKIHESMRYSLLAGGKRVRPMLCIAACELFGGTESVAMPSACAVEMIHTMSLMHDDLPCMDNDDLRRGKPTNHKVFGEDVAVLAGDALLAFAFEHIATATKGVSSERIVRVVGELAKCIGSEGLVAGQVVDVCSEGIADVGLEHLEFIHIHKTAALLEGSVVLGAIVGGANDEQISKLRKFARCIGLLFQVVDDILDVTKSSQELGKTAGKDLVADKVTYPKLLGIDKSREFAEKLNREAQEQLAEFDPEKAAPLIALANYIAYRDN

SEQ ID NO: 123 - protein, 261 aa, Catharanthus roseus
MKSNSWANIESDIQTHLKKSIPIRAPEDVFEPMHYLTFAAPRTTAPALCIAACEVVGGDGDQAMAAAAAIHLVHAAAYAHENLPLTDRRRPKPPIQHKFNSNIELLTGDGIVPYGFELLAKSMDSNNSDRILRVIIEITQAAGSKGIIDGQFRELDVIDSEINMGLIEYVCKKKEGELNACGAACGAILGGGSEEEIGKLRKFGLYAGMIQGLVHGVGKNREEIQELVRKLRYLAMEELKSLKNRKIDTISSLLETDLCSV

SEQ ID NO: 124 - protein, 297 aa, Nepeta cataria
MAPFNFNAYVVEKANRVNKALDDAVEVKNPPMIHEAMRYSLLAGGKRVRPMLCIAACEIVGGHQSAAIPAACAVEMIHTMSLIHDDLPCMDNDDLRRGKPTNHKVFGEEVAVLAGDALLAFAFEFIATATVGVAAERILAAVGELAKAIGTEGLVAGQVVDLNCTGNANVGLETLEFIHIHKTAALLEASVVLGAILGGGSDSEVEKLRTFARKIGLLFQVVDDILDVTKSSEELGKTAGKDLTVDKTTYPKLLGLEKAVEFAEKLNEEAKAQLAEFEPCKAAPLAALADYIAHRQN

SEQ ID NO: 125 - protein, 273 aa, Nepeta cataria
MNQSYWAAIEADIGTYLKKSIPIRPPETVFEPMHHLTFAAPTTAASALCVAACELTGGDRSQALVAASAIHLVHAAAYAHEHLPLTDRPRPESKPEIHHKYSPNIELLTPDGMVPFGFELLARSMDPARDGDPDRILRVIIEISRAGGSEGMIDGLYREEEIADLNYPRPDFIEYVCKKKYGELHACGAACGAILAGAAEEEVEKLRNFGRYAGTLIGIMGNKYNVPEIGNIISKLREFAMEELEKGFHGKNIELISSLVAEPSQVAESLSAA

SEQ ID NO: 126 - protein, 357 aa, Streptomyces aculeolatus
MTTEVTSFTGAGPHPAASVRRITDDLLQRVEDKLASFLTAERDRYAAMDERALAAVDALTDLVTSGGKRVRPTFCITGYLAAGGDAGDPGIVAAAAGLEMLHVSALIHDDILDNSAQRRGKPTIHTLYGDLHDSHGWRGESRRFGEGIGILIGNLALVYSQELVCQAPPAVLAEWHRLCSEVNIGQCLDVCAAAEFSADPELSRLVALIKSGRYTIHRPLVMGANAASRPDLAAAYVEYGEAVGEAFQLRDDLLDAFGDSTETGKPTGLDFTQHKMTLLLGWAMQRDTHIRTLMTEPGHTPEEVRRRLEDTEVPKDVERHIADLVEQGRAAIADAPIDPQWRQELADMAVRAAYRTN

SEQ ID NO: 127 - protein, 352 aa, Streptomyces sp.
MTTDTGQDAVGLARRTGADLLHRVEDRLRSLLAVERDAWAAVHEQAVVPVDALSELIASGGKRIRPAFCITGYLAAGGDPAEPGIVAAGAALEMLHLSALVHDDVLDDSSSRRGVPTVHTQAMALHESSGWQGEPRRYGEGVAILVGDLALVYSEELMAEAPRRVLPEWNKLRSEVMIGQYMDVHAAAEFSVDPRSSRLIARIKSGRYTIHRPLVVGAKRGRGRGDLAPALEEYGEAVGEAFQLRDDLLDASATPAETGKPTGLDFTQHKMTLLLGWAMQRDEHIHTLVTEPGHTPDEVRRRLLDTGVPADVERHIAGLVERGCKAIADAPVDQVWRGELAAMAGRVAYRTA

SEQ ID NO: 128 - protein, 352 aa, Streptomyces cinnamonensis
MACIGTDQELTALARRTREELLEQMEDRLRAFLRAEHELWAEVNERAVGAVAALTDLVAAGGKRIRPAFCIAGYLAAGGDPDDTAVVAAAAALEMLHASALIHDDVIDASSHRRGRPTVHARHSALHDRNAWQGESRRYGEGVAILVGDLALVYSEQLMAAAPPAVLPVWGTLRSELMIGQYMDMTAAAEFLVDPRLSRWIALAKSGHYTIHRPLVVGASAAGRADLAPAFAKYGEAVGEAFQLRDDLLDAFGDFAHTGKPAGLDFSQHKMTLLLSWAMQRDARIHSLITEPGHTPDEVRRRLVDTGVPDDVEKHIAGLVEQGCEAIADVPIDPVWRTELTTMATQAAYRTT

SEQ ID NO: 129 - protein, 351 aa, Streptomyces longwoodensis
MTRRAATDQATSARRTVEDLLQRVQHRLTSFLAAERAHYAEVHEHAVVAIDALADLAAAGGKLLRPAFCLTGYLAAGGDPAEPGIVDAAAALELLHISALVHDDVLDDSRTRRGKPAVHVLHTTLHRTRGWQGESRRFGEGVALLVGDLALVYSDELMAGAPRGAFAEWHRLRSEVMIGQYMDVAAAAEFSVDPDLSRLIALIKSGRYTIHRPLVLGASAAGRTDLAGALAHYGEAVGEAFQLRDDLLDAFGDAARTGKTAGLDFSQHKMTLLLGWAMQRDSRIHDLITEPGHTPDEIRARLLDTGVPADVEQHIAHLVDQGCAALADAPLEPQWRAQLTDMALRVAYRDK

SEQ ID NO: 130 - protein, 352 aa, Streptomyces sp.
MPQNVRGEESAAAARRTVEELLQRVQDRLSGFLAAERARYAEVDERAVVAIDALSDLVEAGGKLVRPAFCLAGYLAAGGDPEAPGIIDAAAALEMLHISALVHDDVLDDSRTRRGKPAVHVLHSSLHRSRGWQGEARRFGEGVALLVGDLALVYSDELMSHAPATAGPEWHRLRSEVMIGQYMDVAAAAEFSVDPALSRLIALIKSGRYTIHRPLVVGASAAGRADLAPALAEYGEAVGEAFQLRDDLLDAFGDAAQTGKTAGLDFSQHKMTLLLGWAMQRDAHIHGLITEPGHTPDEVRARLLDTGVPEEVERHIAALVDQGCAAIADAPVGPQWRSELTNMALRVAYRNK

SEQ ID NO: 131 - protein, 357 aa, Streptomyces sp.
MPVTSDATRDTGQEAVSHARRITTDLLRRVEDRLSSLLAAEREVWAEVHEGAVVPVDALAELMASGGKRIRPAFCVTGYLAAGGDPDAPGIVAAGAALEMLHISALVHDDVLDDSSRRRGLPTVHTKHAALHDSRGWQGESRRYGEGVAVLVGDLALVYSDALMTEAPRQVLPEWNRLRSEVMIGQYLDVHAAAEFSASPRSARLIARIKSGRYTIHRPLVVGAKAAGRDELAPVFEEYGEAVGEAFQLRDDLLDAFGDSTDTGKPTGLDFTQHKMTLLLGWAMQRDERVHGLITEPGHTPGEVRRRLVDTGVPADVERHIAGLVERGCKAIADAPIDQVWRGELADMARRAAYRSA

SEQ ID NO: 132 - protein, 412 aa, Streptomyces aculeolatus
MQYKLALNGKTLKGETTTEAVDAATAEKVFKQYANDNGVDGEWTYDDATKTFTVTETTEVTSFTGAGPHPAASVRRITDDLLQRVEDKLASFLTAERDRYAAMDERALAAVDALTDLVTSGGKRVRPTFCITGYLAAGGDAGDPGIVAAAAGLEMLHVSALIHDDILDNSAQRRGKPTIHTLYGDLHDSHGWRGESRRFGEGIGILIGNLALVYSQELVCQAPPAVLAEWHRLCSEVNIGQCLDVCAAAEFSADPELSRLVALIKSGRYTIHRPLVMGANAASRPDLAAAYVEYGEAVGEAFQLRDDLLDAFGDSTETGKPTGLDFTQHKMTLLLGWAMQRDTHIRTLMTEPGHTPEEVRRRLEDTEVPKDVERHIADLVEQGRAAIADAPIDPQWRQELADMAVRAAYRTN

SEQ ID NO: 133 - protein, 407 aa, Streptomyces sp.
MQYKLALNGKTLKGETTTEAVDAATAEKVFKQYANDNGVDGEWTYDDATKTFTVTETTDTGQDAVGLARRTGADLLHRVEDRLRSLLAVERDAWAAVHEQAVVPVDALSELIASGGKRIRPAFCITGYLAAGGDPAEPGIVAAGAALEMLHLSALVHDDVLDDSSSRRGVPTVHTQAMALHESSGWQGEPRRYGEGVAILVGDLALVYSEELMAEAPRRVLPEWNKLRSEVMIGQYMDVHAAAEFSVDPRSSRLIARIKSGRYTIHRPLVVGAKRGRGRGDLAPALEEYGEAVGEAFQLRDDLLDASATPAETGKPTGLDFTQHKMTLLLGWAMQRDEHIHTLVTEPGHTPDEVRRRLLDTGVPADVERHIAGLVERGCKAIADAPVDQVWRGELAAMAGRVAYRTA

SEQ ID NO: 134 - protein, 407 aa, Streptomyces cinnamonensis
MQYKLALNGKTLKGETTTEAVDAATAEKVFKQYANDNGVDGEWTYDDATKTFTVTEACIGTDQELTALARRTREELLEQMEDRLRAFLRAEHELWAEVNERAVGAVAALTDLVAAGGKRIRPAFCIAGYLAAGGDPDDTAVVAAAAALEMLHASALIHDDVIDASSHRRGRPTVHARHSALHDRNAWQGESRRYGEGVAILVGDLALVYSEQLMAAAPPAVLPVWGTLRSELMIGQYMDMTAAAEFLVDPRLSRWIALAKSGHYTIHRPLVVGASAAGRADLAPAFAKYGEAVGEAFQLRDDLLDAFGDFAHTGKPAGLDFSQHKMTLLLSWAMQRDARIHSLITEPGHTPDEVRRRLVDTGVPDDVEKHIAGLVEQGCEAIADVPIDPVWRTELTTMATQAAYRTT

SEQ ID NO: 135 - protein, 406 aa, Streptomyces longwoodensis
MQYKLALNGKTLKGETTTEAVDAATAEKVFKQYANDNGVDGEWTYDDATKTFTVTETRRAATDQATSARRTVEDLLQRVQHRLTSFLAAERAHYAEVHEHAVVAIDALADLAAAGGKLLRPAFCLTGYLAAGGDPAEPGIVDAAAALELLHISALVHDDVLDDSRTRRGKPAVHVLHTTLHRTRGWQGESRRFGEGVALLVGDLALVYSDELMAGAPRGAFAEWHRLRSEVMIGQYMDVAAAAEFSVDPDLSRLIALIKSGRYTIHRPLVLGASAAGRTDLAGALAHYGEAVGEAFQLRDDLLDAFGDAARTGKTAGLDFSQHKMTLLLGWAMQRDSRIHDLITEPGHTPDEIRARLLDTGVPADVEQHIAHLVDQGCAALADAPLEPQWRAQLTDMALRVAYRDK

SEQ ID NO: 136 - protein, 407 aa, Streptomyces sp.
MQYKLALNGKTLKGETTTEAVDAATAEKVFKQYANDNGVDGEWTYDDATKTFTVTEPQNVRGEESAAAARRTVEELLQRVQDRLSGFLAAERARYAEVDERAVVAIDALSDLVEAGGKLVRPAFCLAGYLAAGGDPEAPGIIDAAAALEMLHISALVHDDVLDDSRTRRGKPAVHVLHSSLHRSRGWQGEARRFGEGVALLVGDLALVYSDELMSHAPATAGPEWHRLRSEVMIGQYMDVAAAAEFSVDPALSRLIALIKSGRYTIHRPLVVGASAAGRADLAPALAEYGEAVGEAFQLRDDLLDAFGDAAQTGKTAGLDFSQHKMTLLLGWAMQRDAHIHGLITEPGHTPDEVRARLLDTGVPEEVERHIAALVDQGCAAIADAPVGPQWRSELTNMALRVAYRNK

SEQ ID NO: 137 - protein, 412 aa, Streptomyces sp.
MQYKLALNGKTLKGETTTEAVDAATAEKVFKQYANDNGVDGEWTYDDATKTFTVTEPVTSDATRDTGQEAVSHARRITTDLLRRVEDRLSSLLAAEREVWAEVHEGAVVPVDALAELMASGGKRIRPAFCVTGYLAAGGDPDAPGIVAAGAALEMLHISALVHDDVLDDSSRRRGLPTVHTKHAALHDSRGWQGESRRYGEGVAVLVGDLALVYSDALMTEAPRQVLPEWNRLRSEVMIGQYLDVHAAAEFSASPRSARLIARIKSGRYTIHRPLVVGAKAAGRDELAPVFEEYGEAVGEAFQLRDDLLDAFGDSTDTGKPTGLDFTQHKMTLLLGWAMQRDERVHGLITEPGHTPGEVRRRLVDTGVPADVERHIAGLVERGCKAIADAPIDQVWRGELADMARRAAYRSA

SEQ ID NO: 138 - protein, 349 aa, Penicillium aethiopicum
MATSTTTSLKEFLSVFPQLVADLRALCLEEYQLPACVWDRFESTLNHNTLGGKCNRGLSVIDSVRLLRDGLELSPAEYFDAAVLGWLVELLQATMLVLDDIMDGSPTRRGKPSWYRVPGVGMAAVNDATMLESAIYMLLKKYFAGRAIYLPVVDLFHETALQIELGQAFDMLIANEGTPDLTTFVPATYSQIVTYKTAFYSFYLPVALALHAVDAATPTNLAAARAILVPMGEYFQVQDDYLDCFADPTVLGKVGTDIIEGKCSWLVVQALQRASTDQAQLLAENYGSASGESSVKALYSELDLESVYRTFEEQRVAELRTLITGLDESQGLRKSVFEELLGKIYQRRK

SEQ ID NO: 139 - protein, 404 aa, Penicillium aethiopicum
MQYKLALNGKTLKGETTTEAVDAATAEKVFKQYANDNGVDGEWTYDDATKTFTVTEATSTTTSLKEFLSVFPQLVADLRALCLEEYQLPACVWDRFESTLNHNTLGGKCNRGLSVIDSVRLLRDGLELSPAEYFDAAVLGWLVELLQATMLVLDDIMDGSPTRRGKPSWYRVPGVGMAAVNDATMLESAIYMLLKKYFAGRAIYLPVVDLFHETALQIELGQAFDMLIANEGTPDLTTFVPATYSQIVTYKTAFYSFYLPVALALHAVDAATPTNLAAARAILVPMGEYFQVQDDYLDCFADPTVLGKVGTDIIEGKCSWLVVQALQRASTDQAQLLAENYGSASGESSVKALYSELDLESVYRTFEEQRVAELRTLITGLDESQGLRKSVFEELLGKIYQRRK

SEQ ID NO: 140 - protein, 360 aa, Ocimum basilicum
MAKSPETEHPVKALGWAATDNSGTFSPFNFSRRATGERDVQFRVLYCGVCHSDLHMVKNEWGVTHYPIVPGHEIVGIVTEVGSKVEKVKIGDKVGVGVLVGSCRQCDQCSNDLENYCYKQILTYGAPYLDGTIARGGYSDIMVADEHFIIRWPENFPLDAGAPLLCAGITTYSPLKYFGLDKPGLRVGVNGLGGLGHVAVKFAKAFGTKVTVISTSLSKKEEAMQHLGVDEFVVSTDPQQMQAAVGTLDGIIDTVSAPHPIVPLLSLLKPHGKLIVVGLPDKPLQLPVFPLIQGRRTIAGSGIGGLKETQEMIDFAAKNNIVADVEVIPIDYINTAMDRLLKSDVKYRFVIDVEKSLKPQ

SEQ ID NO: 141 - protein, 547 aa, Catharanthus roseus
MSSSSSSSSSMSLPLATPLIKDNESLIKFLRQPLVLPHEVDDSTKRRELLERTRKELELNAEKPLEALKMIDIIQRLGLSYHFEDDINSILTGFSNISSQTHEDLLTASLCFRLLRHNGHKINPDIFQKFMDNNGKFKDSLKDDTLGMLSLYEASYLGANGEEILMEAQEFTKTHLKNSLPAMAPSLSKKVSQALEQPRHRRMLRLEARRFIEEYGAENDHNPDLLELAKLDYNKVQSLHQMELSEITRWWKQLGLVDKLTFARDRPLECFLWTVGLLPEPKYSGCRIELAKTIAILLVIDDIFDTHGTLDELLLFTNAIKRWDLEAMEDLPEYMRICYMALYNTTNEICYKVLKENGWSVLPYLKATWIDMIEGFMVEAEWFNSDYVPNMEEYVENGVRTAGSYMALVHLFFLIGQGVTEDNVKLLIKPYPKLFSSSGRILRLWDDLGTAKEEQERGDLASSIQLFMREKEIKSEEEGRKGILEIIENLWKELNGELVYREEMPLAIIKTAFNMARASQVVYQHEEDTYFSSVDNYVKALFFTPCF

SEQ ID NO: 142 - protein, 505 aa, Ocimum basilicum
MQHMEESSSKRREYLLEETTRKLQRNDTESVEKLKLIDNIQQLGIGYYFEDAINAVLRSPFSTGEEDLFTAALRFRLLRHNGIEISPEIFLKFKDERGKFDESDTLGLLSLYEASNLGVAGEEILEEAMEFAEARLRRSLSEPAAPLHGEVAQALDVPRHLRMARLEARRFIEQYGKQSDHDGDLLELAILDYNQVQAQHQSELTEIIRWWKELGLVDKLSFGRDRPLECFLWTVGLLPEPKYSSVRIELAKAISILLVIDDIFDTYGEMDDLILFTDAIRRWDLEAMEGLPEYMKICYMALYNTTNEVCYKVLRDTGRIVLLNLKSTWIDMIEGFMEEAKWFNGGSAPKLEEYIENGVSTAGAYMAFAHIFFLIGEGVTHQNSQLFTQKPYPKVFSAAGRILRLWDDLGTAKEEQERGDLASCVQLFMKEKSLTEEEARSRILEEIKGLWRDLNGELVYNKNLPLSIIKVALNMARASQVVYKHDQDTYFSSVDNYVDALFFTQ

SEQ ID NO: 143 - protein, 507 aa, Valeriana officinalis
MIMELVEATRRTLRNESSDSTEKMRLIDSLQRLGLNHHFEQDIKEMLQDFANEHKNTNQDLFTTSLRFRLLRHNGFNVTPDVFNKFTEENGKFKESLGEDTIGILSLYEASYLGGKGEEILSEAMKFSESKLRESSGHVAPHIRRQIFQSLELPRHLRMARLESRRYIEEDYSNEIGADSSLLELAKLDFNSVQALHQMELTEISRWWKQLGLSDKLPFARDRPLECFLWTVGLLPEPKYSGCRIELAKTIAVLLVIDDIFDTYGSYDQLILFTNAIRRWDLDAMDELPEYMKICYMALYNTTNEICYKVLKENGWSVLPYLERTWIDMVEGFMLEAKWLNSGEQPNLEAYIENGVTTAGSYMALVHLFFLIGDGVNDENVKLLLDPYPKLFSSAGRILRLWDDLGTAKEEQERGDVSSSIQLYMKEKNVRSESEGREGIVEIIYNLWKDMNGELIGSNALPQAIIETSFNMARTSQVVYQHEDDTYFSSVDNYVQSLFFTPVSVSV

SEQ ID NO: 144 - protein, 547 aa, Catharanthus roseus; identical to SEQ ID NO: 141

SEQ ID NO: 145 - protein, 505 aa, Ocimum basilicum; identical to SEQ ID NO: 142

SEQ ID NO: 146 - protein, 507 aa, Valeriana officinalis; identical to SEQ ID NO: 143

SEQ ID NO: 147 - protein, 547 aa, Catharanthus roseus; identical to SEQ ID NO: 141

SEQ ID NO: 148 - protein, 505 aa, Ocimum basilicum; identical to SEQ ID NO: 142

SEQ ID NO: 149 - protein, 569 aa, Perilla citriodora
MSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYV

SEQ ID NO: 150 - protein, 507 aa, Valeriana officinalis; identical to SEQ ID NO: 143

SEQ ID NO: 151 - protein, 150 aa, Rosa hybrid cultivar
MGNETVVVAETAGSIKVAVVVCLLRGQNVLLGRRRSSLGDSTFSLPSGHLEFGESFEECAARELKEETDLDIGKIELLTVTNNLFLDEAKPSQYVAVFMRAVLADPRQEPQNIEPEFCDGWGWYEWDNLPKPLFWPLDNVVQDGFNPFPT

SEQ ID NO: 152 - protein, 147 aa, Arabidopsis thaliana
MSTGEAIPRVAVVVFILNGNSILLGRRRSSIGNSTFALPGGHLEFGESFEECAAREVMEETGLKIEKMKLLTVTNNVFKEAPTPSHYVSVSIRAVLVDPSQEPKNMEPEKCEGWDWYDWENLPKPLFWPLEKLFGSGFNPFTHGGGD

SEQ ID NO: 153 - protein, 602 aa, Catharanthus roseus
MQYKLALNGKTLKGETTTEAVDAATAEKVFKQYANDNGVDGEWTYDDATKTFTVTESSSSSSSSSMSLPLATPLIKDNESLIKFLRQPLVLPHEVDDSTKRRELLERTRKELELNAEKPLEALKMIDIIQRLGLSYHFEDDINSILTGFSNISSQTHEDLLTASLCFRLLRHNGHKINPDIFQKFMDNNGKFKDSLKDDTLGMLSLYEASYLGANGEEILMEAQEFTKTHLKNSLPAMAPSLSKKVSQALEQPRHRRMLRLEARRFIEEYGAENDHNPDLLELAKLDYNKVQSLHQMELSEITRWWKQLGLVDKLTFARDRPLECFLWTVGLLPEPKYSGCRIELAKTIAILLVIDDIFDTHGTLDELLLFTNAIKRWDLEAMEDLPEYMRICYMALYNTTNEICYKVLKENGWSVLPYLKATWIDMIEGFMVEAEWFNSDYVPNMEEYVENGVRTAGSYMALVHLFFLIGQGVTEDNVKLLIKPYPKLFSSSGRILRLWDDLGTAKEEQERGDLASSIQLFMREKEIKSEEEGRKGILEIIENLWKELNGELVYREEMPLAIIKTAFNMARASQVVYQHEEDTYFSSVDNYVKALFFTPCF

SEQ ID NO: 154 - protein, 560 aa, Ocimum basilicum
MQYKLALNGKTLKGETTTEAVDAATAEKVFKQYANDNGVDGEWTYDDATKTFTVTEQHMEESSSKRREYLLEETTRKLQRNDTESVEKLKLIDNIQQLGIGYYFEDAINAVLRSPFSTGEEDLFTAALRFRLLRHNGIEISPEIFLKFKDERGKFDESDTLGLLSLYEASNLGVAGEEILEEAMEFAEARLRRSLSEPAAPLHGEVAQALDVPRHLRMARLEARRFIEQYGKQSDHDGDLLELAILDYNQVQAQHQSELTEIIRWWKELGLVDKLSFGRDRPLECFLWTVGLLPEPKYSSVRIELAKAISILLVIDDIFDTYGEMDDLILFTDAIRRWDLEAMEGLPEYMKICYMALYNTTNEVCYKVLRDTGRIVLLNLKSTWIDMIEGFMEEAKWFNGGSAPKLEEYIENGVSTAGAYMAFAHIFFLIGEGVTHQNSQLFTQKPYPKVFSAAGRILRLWDDLGTAKEEQERGDLASCVQLFMKEKSLTEEEARSRILEEIKGLWRDLNGELVYNKNLPLSIIKVALNMARASQVVYKHDQDTYFSSVDNYVDALFFTQ

SEQ ID NO: 155 - protein, 624 aa, Perilla citriodora
MQYKLALNGKTLKGETTTEAVDAATAEKVFKQYANDNGVDGEWTYDDATKTFTVTESSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYV

SEQ ID NO: 156 - protein, 562 aa, Valeriana officinalis
MQYKLALNGKTLKGETTTEAVDAATAEKVFKQYANDNGVDGEWTYDDATKTFTVTEIMELVEATRRTLRNESSDSTEKMRLIDSLQRLGLNHHFEQDIKEMLQDFANEHKNTNQDLFTTSLRFRLLRHNGFNVTPDVFNKFTEENGKFKESLGEDTIGILSLYEASYLGGKGEEILSEAMKFSESKLRESSGHVAPHIRRQIFQSLELPRHLRMARLESRRYIEEDYSNEIGADSSLLELAKLDFNSVQALHQMELTEISRWWKQLGLSDKLPFARDRPLECFLWTVGLLPEPKYSGCRIELAKTIAVLLVIDDIFDTYGSYDQLILFTNAIRRWDLDAMDELPEYMKICYMALYNTTNEICYKVLKENGWSVLPYLERTWIDMVEGFMLEAKWLNSGEQPNLEAYIENGVTTAGSYMALVHLFFLIGDGVNDENVKLLLDPYPKLFSSAGRILRLWDDLGTAKEEQERGDVSSSIQLYMKEKNVRSESEGREGIVEIIYNLWKDMNGELIGSNALPQAIIETSFNMARTSQVVYQHEDDTYFSSVDNYVQSLFFTPVSVSV

SEQ ID NO: 157 - protein, 542 aa, Vinca minor
MSMPLSMSQPIATPFITDNESLLKFLRQPLVLPHEVDDSTKRRELLERTRKELQISEDQPLEALKMIDTIERLGLAYHFEEDINSLLTGFSNAQSDEDLLTASLRFRLLRHNGHKINPDIFLKFMDKNGKFKESLKEETLGMLSLYEASYLGANGEDILEQALEFTQAHLKKSISGVAPPLSKKISQALELPRHRRMARLEARRFIDEYGGESDHNPDLLELAKLDYNKVQSLHQMELSEISRWWKQLGLVDKLTFARDRPLECFLWTVGLLPEPKYSACRIELAKTIAILLVIDDIFDTHGTLDELLLFTNAIRRWDLEAIEDLPEYMRICYMALYNTTNEICYKVLKENGWSVLPYLKATWIDMIEGFMVEAEWFNSDYVPNMEEYVENGVTTAGSYMALVHLFFLMGQGVTEDNVKLLLKPYPKLFSSSGRILRLWDDLGTAKEEQERGDLASSIQLFMREKNIKSDEEGRKCILEIIDKLWKEMNGEVVSRNNSLPLPIIKVAFNMARASQVVYQHEEDSYFSSVDNYVQSLFFTPFN

SEQ ID NO: 158 - protein, 541 aa, Cinchona pubescens
MCLPSQTLTQPIATPLITDNDSLLKYLRQPLMLPHEVDDSTKRKELLERTRRELRSTTEPLEAMKLIDTLQRLGIAYHFEDDMNVILSSFSSDGQSDEDLFTAALRFRLLRHNGHKISPDIFQRFKDHKGKFKDSLKEDTLGMLSLYEASHLGANGEDILSEAMEFSEAHLKKSLPKLEPLPAKHVSKALELPRHRRMARLEARRYIEEYGKESGHNPDLLELAKLDYNKVQSLHQMELSEITRWWKQLGLVDKLTFARDRPLECFLWTVGILPEPKYSSCRIELAKTIAILLVIDDIFDTHGTVDELVLFTNAIRRWDLEAMEELPEYMKICYMALYNTTNEICYKILKEKGWSVLPYLKSTWIDMIEGFMMEASWYSNAQIPNMEEYVENGVTTAGAYMALVHLFFLIGQGVTQDNVKLLMKPYPKLFSSSGRILRLWDDLGTAKEEQERGDLASSIQLFMRENNITCDEEGRKRILLLIDNLWKDLNWELVSRNELPLSIIKAAFNMARASQVVYQHEEDSYFSSVDNYVQALFFTPI

SEQ ID NO: 159 - protein, 523 aa, Rauvolfia serpentina
MNLSLSFCANLWCFLMRLMRTTRGGNCWKEQEKNLLTSADQPLEALKMIDTLQRLGLAYHFEDDINSILTGFSSSQSDEDLLTAALRFRLLRHNGHKISSDVFQKFMDNKGKFKESLKEDTLGLLSLYEASYLGANGEDILMQALEFTQAHLKKSLSGLAPPLAKKISQGLELPRHRRMARLEARRFIEEYGGESDHKPDLLELAKLDYNKVQSLHQMELSEITRWWKQLGLVDKLTFARDRPLECFLWTVGILPEPKFSACRIELAKTIAILLVIDDIFDTHGTIDELVLFTNAIRRWDLEAMENLPEYMRICYMALYNTTNEICYKVLKENGWSVLPYLKATWIDMIEGFMLEAQWFNSGYVPNMEEYVENGVTTAGAYMALVHLFFLIGQGVTQENVKLLVRPYPKLFSSSGRILRLWDDLGTAKEEQERGDLASSIQLFMRENSITSDEEGRKRILQIIDNLWKELNGELMSRNALPLEIVKAAFNMARASQVVYQHEEDSYFSSVDNYVQALFFTPFN

SEQ ID NO: 160 - protein, 586 aa, Swertia japonica
MVITRNFASFSEVCISSGTLFSYLRRQYNQYPIAKTSHICMCMPLSTSTMSSQPIATPLIKDNESLLRYLRQPMVLPHELDDDTKRRELVERTRRELQSMSKPLEAMKMIDTLDRLGIAYHFEDDINAILTTFSKNAQPNEDLLTTSLRFRLLRHNGFKISPEIFEKFLDQNGKFEESLTKDIPGLISLYEASYMGAGGEEILLQALEFSEGHLKSSKNNLTPQLSRQVSQALELPRHRRMARLEARRYIEEYSKENQYNNPDLLELAKLDYNKVQALHQMELTEITRWWKQLGLVDKLPFARDRPLECFLWTVGLMPEPKYSGCRIELAKTIAILLVIDDIFDTHGTIDELVLFTNAIRRWDLKAMEELPEYMRICYMALYNTTNEISYKILKENGWSVLPYLKAVWIDVVDGFMMEASWFSNGQVPKVEEYLENGVTTAGSYMALVHVFFLIGKGVTEESVQLLMNPYPKLFSNSGSILRLWDDLGTAKEEQERGDVASIIILFMKEKNITSDEEARECILQLIHNIWKELNGELVSRNGLPLEIKKVALNMARASQVVYQHEEDTYFSNVDNYVMALFFTPFN

SEQ ID NO: 161 - protein, 480 aa, Coffea canephora
MNLIDTLQRLGLAYHFEDDMNAILSQLSSSGQSDGDLLTTALRFRLLRHNGHKISSDIFQKFMDKNGKFKDSLKEDTMGLLSLYEASHLAANGEDILLEAMELTEAHLKQSLPSLPTQLARKVSSALELPRHRRMARLEARRYIQEYSEEIGHDPNLLELAKLDYNKVQSLHQMELTDISRWWKQLGLVDKLTFARDRPLECFLWTVGILPEPKYSNCRIELAKTIAILLVIDDIFDTHGTIDELVLFTNAIRRWDLEAMEGLPEYMRICYMALYNTTNEICYKILKENGWSVLPYLKATWIDMIEGFMLEASWYSNGQEPNMEEYVANGVTTAGTYMAMVHLFFLIGQGVTEENVKLLMKPYPKLFSCSGRILRLWDDLGTAKEEQERGDLASSIQLFMRENNITCDEEGRKRILQLIDNLWKDLNWGLVSRNAMPLAIIKAAFNMARSSQVVYQHEEESYFSSVDNYVESLFFTPIIN

SEQ ID NO: 162 - protein, 609 aa, Citrus unshiu
MREKMISCEEEARKHIRQLIRSLWVELNGMLVAPAALPASIVNASLNLARTAQVVYQHGDDSTVTSVNGHIERLLNGGNCWSIKEDEKFMEFVDDSLLQFCKRKMLKYQLVWLVNGLGLAIEKMMVRWLTGECSLLEDLFCFDCWDLKHFCVSRAVKLKLDMLGCKMEATPFLETSGGSGYTRLDKINVGKAVEYILSCRNLDGGFWWGVSCRANYASYLATQDEDILFQAMEFTKTELTQSVSLMDSQSSRHVVQALALPRHLRMSRSEAGNYINEYSQSWNHDQTLLQLAKSDFNMVQSLHQRELAEIKRWWKQLGLVDKLGFGRDRPLECFLWTVGIFPEPYYSNCRIELAKTIALLLVIDDIFDTYGSLSDLVLFTEAIQRWDLGAMEHIPEYMKICYMALYNTTNEISYRILKDHGWNVVPQLKRTWIDIFKAQLSEAKWFSEGYVPTQEQYLRNGVTTGGTYMALVHAFCLMGQDVTKETLAMMEPYPNLFSCSGKILRLWDDLGAAREEQERGDVASSIECYMREKTISCEEEARKHIRQLIRSLWVELNGMLVAPAALPASIVNASLNLARTAQVVYQHGDDNTVTSVNGHIERLFCNPLT

SEQ ID NO: 163 - protein, 412 aa, Citrus unshiu
MQPEENLFENALAFYVCIEASYLATQDEDILFQAMEFTKTELTQSVSLMDSQSSRHVVQALALPRHLRMSRSEAGNYINEYSQSWNHDQTLLQLAKSDFNMVQSLHQRELAEIKRWWKQLGLVDKLGFGRDRPLECFLWTVGIFPEPYYSNCRIELAKTIALLLVIDDIFDTYGSLSDLVLFTEAIQRWDLGAMEHIPEYMKICYMALYNTTNEISYRILKDHGWNVVPQLKRTWIDIFKAQLSEAKWFSEGYVPTQEQYLRNGVTTGGTYMALVHAFCLMGQDVTKETLAMMEPYPNLFSCSGKILRLWDDLGAAREEQERGDVASSIECYMREKTISCEEEARKHIRQLIRSLWVELNGMLVAPAALPASIVNASLNLARTAQVVYQHGDDNTVTSVNGHIERLFCNPLT

SEQ ID NO: 164 - protein, 576 aa, Glycine soja
MTSSLESMEAWAAASLALTVSRRSTQAAKSSVYIIKERQVEPIVISRGRRERLNYLVPSQTYLGTKDLDQVIRKGQEALLNSSDPLRTLKIIDTIQKLGIEHHFEKEINLQLGRVGDWDTAEDLFATALQFRLLRHNGWPTCSDVFNKFLDKSGNFKESVTRDIWGMLSLYEASYLGAKGEEVLQQAMDYSRAHLCQSLPHLSPKVRSIVAEALKLPRHQRMVGLEAKNYMVEYSQASNQIPALLKLARLDYDMIQSMHQKELAEISRWWKDLGLIERLGFGRDGPRECFLWALGIFPEPRHSSCRIELAKAICVLQVIDDVFDTYGTLDELVLFTKAIKRWDLDAMEQLPEYMKICYMALYNTTHEIAYKIQKDHSLTVVACLKITWIDLIEAYLKEANWFNNKHVPTFQQYLDNGVISSGSYLALVHATFLIGDDLSKETIFMMNPYPRLFSCSGKILRLWDDLGTSRDEQERGDNACSIQCLMKQNNISDENVARKLIRQLIDNLWPELNGLTMTTNLPLSVMRASLNMARTSQVIYRHGDDQNMPTVDEHVQTLLFTPSINYRDENDINHVI

SEQ ID NO: 165 - protein, 542 aa, Cynara cardunculus
MCLSFSTLPSSTIAVPLNRDNDSLLHVYQPKAILPKAVVYDRIEQLKENTRRALMSISDPITRMELIDTIQRLGVGHHFDEEMHEILENLTEDLPDDNLYAVALCFRLQRHNGLHTNPDVFQNFMDANGKFKMSSSDDIEVLLSLYEASYLGANGEDILSQAKEFTTMQLTSLVSQLNPKLGTKVLLSLGLPRHLRMTRLEARRYIDEYGNEDDHNPIVLELAKLDYNHVQSLLQRELVEVTRWWEHLGLLKKLSFVRDRHLECFLWTVGVLPEKKYSGGRIELAKIIAILLVIDDIYDIYGSYEDLVLFTEAIRRWDLSEMEHLPEYMKISYTALYNTTSEICHKILKEHGLSVEPFLHQTWIDMVEAYMVEVEWVRSGTMPTFEDYIKNGVTTSGTCMALVHLFFLISEGVTEENMRHLLDPYPKFFSLAGTILRLWDDLGTSKEEQERGNVASSIQLLMREKNITSEEEGRKKILQLINELWKDLNTELVTPDALLLPMIKVALNMSRASQVVYQHNEDSYLTSVESQVQYLFFKPIDI

SEQ ID NO: 166 - protein, 484 aa, Dorcoceras hygrometricum
MKLIDNLQWLGLGHHFEDESNLWLEKLSGESASVDEDDLHSTALLFRLLRQHMKPINCDILEKFTRDQNIRDSLIKDKEGLLSLYEASYLGSNDEGVLSEAMKFTETLLIKSPVRPECDLSQRIGRALELPRHRRMVRLESRSRIKEYGMRTSQSSRLLQLAKLDYNKVQLLHQMELAQFTRWWKQLGLADKLGFVRNSTAECFLWTVGLFPHPKYSGVRVEMAKVIAILLAIDDVFDKYGTMNDLSLFTLAIQKWDLDAIETLPEYMKMCFMALYNTTREIANKVLKEHGVDIHHFLARSWIDTIEAFMIEFKWFSRREEPISAEDYMENGAATAGAYMALVHAFFLMGEGLTNHNIKLMSKPYPELFSASGRILRLWDDLGTSKEEEDRGDSASIIGILMEEKNLSSENEARQHIKQTILNLWKDLNGNLSTDSINPLPLPIINVCFNMCRTAQVFYQHQEYSYVSNVGRMADVIFFEHIGI

SEQ ID NO: 167 - protein, 518 aa, Dorcoceras hygrometricum
MKRSTIGIEELTEKARKELQILNYIEPVRGMILIDNLQWLGIGYHFEDEINLWLDKLSEWDCGEDDLHATALRFRLLRQQLRPTSCGSVFENILEDHKKRKSKPSLNQVEGLLNLYEASYLGASGEEILSEAMKFAETQLASLVNGTCGTADGNLYRRISLALELPRHHRMVRLESRRHIEDCSTHIHCSPSMHLVELAKLDYNRVQLLHKMELEEFRRWWRQLGLVGELSFARDPEAECFFWVVGCFPDPRHSGVRMEMAKTIAILITIDDVFDKHGTIDELLLFTHAVQRWDVDAIENLPDYMKICYMALYKTTTEIAQKILKQHGIDVLHFLSRAWIDTIEAYMIEAKWFQNGQIPSVEDYIENGTTTGGSYMALVHAFFLMGEGITNHNMQLMRKPYPKLFSTSGRILRLWDDLGTSKEEQDFGDNSSLIPVLMKEKNLSSEDEARRCIKQFIRQSWGELNTNLLESNIWPLSLINVCFNMCRTSEAIYHHQESSYLSSFKRTAKIKLLEPITN

SEQ ID NO: 168 - protein, 454 aa, Helianthus annuus
MNTSDSTMTLKLIDTIQRLGVGYYYEEEIKKILKKLTHVLPKDDLYTVALHFRLQRHYGLHTNPAEVFRIFMDENGELKKSSSEDIKGVLSLYEASCLGSSGEDFLLHHKEITRRHLSRSVSKLSPKLHKNVVEGLKLPRHMRMERLEARRYIEEYGNEDDHNPFVLEFAKWCEHLGLFCKLVFVRDRHVECFLWTVGLLPEPSFSGSRIELAKTIAIMLVIDDIYDTYGSYDDLVLFTEAIKRWDLNAIEQLPEYMKICYQALYNTNNEICDKWIDMAEAYMVEAEWVKRGSIPNLNDYIENGVTTSGTYMALVHLFFLISYGLTTENMKHLLDPYPKFFTMAGTILRLWDDLGTIKEEEERGDMLSSIHLLMKEENITCEEEGREGILQMIYALWNDLNVELLTPDAVLFPMIKVALNMSRTSQVVYQHNDDSYLLSVKDHVQSLFYEPVDI

SEQ ID NO: 169 - protein, 400 aa, Actinidia chinensis
MLSLYEASYLGAYGEDILSHAMEFTDSRLKQSVPFMAPQLGKHVSQALELPRHLRMERLEASRFIAEFGRESDQSSQLLELAKMDYNKVQSLHQTELAEISRWWKQLGLVDKLSFGRDRPLECYLWSVGLLPEPKYSDCRIELAKTVAILLVIDDIFDTYGSLDELVLFTQAIRRWDLSAMEQLPQYMKICYMALFNTTNEIGYKVLKDHGWSVVPHLKRTWIDMIEAFLVEANWFSNGYVPNLEEYLENGVTTAGSYMALVHLFFLIGKGVTKETIGMMDPYPKLFSSSGRILRLWDDLGTATDEQERGDVASSIDCFRREKNLSTEGEARNHVKKHIRSLWKELNGELMAPKALPLPLIKTSFNMSRTAQVIYQHGDNNTFPCVDDCVQSLFFTPIGF

SEQ ID NO: 170 - protein, 541 aa, Cinchona ledgeriana
MCMPSQTLTQPIATPLITDNDSLLKYLRQPLMLPHEVDDSTKRKELLERTRRELRSTTEPLEAMKLIDTLQRLGIAYHFEDDMNVILSSFSSDGQSDEDLFTAALRFRLLRHNGHKISPDIFQRFKDHNGKFKDSLKEDTLGILSLYEASHLGANGEDILLEAMEFSEAHLKKSHPKLEPLPAKHVSKALELPRHRRMARLEARRYIEEYSTESGHNPDLLELAKLDYNKVQSLHQMELSEITRWWKQLGLVDKLTFARDRPLECFLWTVGILPEPKYSSCRIELAKTIAILLVIDDIFDTHGTVDELVLFTNAIRRWDLEAMEELPEYMKICYMALYNTTNEICYKILKEKGWSVLPYLKSTWIDMIEGFMMEASWYSNGQIPNMEEYVENGVTTAGAYMALVHLFFLIGQGVTQDNVKLLMKPYPKLFSSSGRILRLWDDLGTAKEEQERGDLASSIQLFMRENNITCDEEGRKRILLLIDNLWKDLNWELVSRNELPLSIIKAAFNMARASQVVYQHEEDSYFSSVDNYVQALFFTPI

SEQ ID NO: 171 - protein, 491 aa, Lonicera japonica
MQQESSNPTDKLKLIDTLQRLGVAYHFEEDINSLLQGFSNGQPNENEYDPFTTSLRFRLLRHNGYHVSTDVFKKFMDKNGKFKESLGGDLMGMLSLYEASHLGANGEDILSEAMKFTETKLKESAAHVAPQIRRQILQSLELPRHLRMARLESRRYIEEYGRESGHNLALLELAKLDYNNVQSLHQLELAEISRWWKHLGLVDKLTFARDRPLECFLWTVGLLPEPKHSGCRIELAKTIAILLVIDDIFDTHGSFDQLVLFTNAIRRWDLNAMEELPEYMKICYMALYNTTNEICYKVLKENGWSVLPYLKRTWIDMIEGFMLEAEWLNSGHVPNLEEYIENGVTTAGSYMALVHLFFLIGEGVTDDNVKLLLDPYPKLFSCSGRILRLWDDLGTAKEEQERGDVASSIQLFMRENNVSSEGEARKQIIEIIQGLWKELNGELMGPNALPLPIIKTSFNMARTSQVVYQHDEDSYFSSVDSYVQSLFFTPI

SEQ ID NO: 172 - protein, 557 aa, Cinchona pubescens
MSSKKPSHICMCMPMPSTTSTQLIATPLIRDNESLLKYLRQPMVLPHEVQPMVLPHEVDDGTMRKELLEITRRELISTPEPLEAMKLIDTIQRLGLAYHFEDEMNAILSGISSKIPYEHEDLLTAGLRFRLLRHNGQKISPDIFKKFMDSNGKFKESLKEDTIGLLCLYEASHMGANGEDILLEALEFSESNIRRSLSSLQPQLARKVSQALELPRHRRMIRLEARRFIEEYGQESGHNPDLLELAKLDYNKVQSLHQMELSEISRWWKQLGLVDKLTFARDRPLECFLWTVGLLPEPKYSACRIELAKTIAILLVIDDIFDTHGTIDELVMFTNAIRRWDLDAMEELPEYMRICYMALYNTTNEICYKVLKENGWSVLPYLKATWIDMIEGFMMEASWYNNDVVPNMEEYVENGVTTAGAYMALVHLFFLIGQGVTQESVKLLMKPYPKLFSCSGRILRLWDDLGTAKEEQERGDLASSIQLFMKENNIKSDEEGRKGILQLIHNLWKDLNSELVSRNAMPLAIIKAAFNMARASQVVYQHEEDSYFSSVDNYVKA

SEQ ID NO: 173 - protein, 531 aa, Nepeta mussinii
MAATTTSPNLAPVVHNNDHMLEIVESTKKREYLVEKITEKLTEASSEKLKLIDEIQRLGIGYHFEDVIKSIMQVQCSAFSTEEDLFTTALRFRLLRQAGFHVIPEVFTRFKDKSGNFKESLGGDTLGLLSLYEASHIGVDGERMLEDARQFTESYLRQSLAKLAPRLRGEVGQALEVPRHHRMVRLEARRFIQEYGKQSGHDRDLLELAILDYNQVQAQHNMELTEIVRWWKELGLVDKLSFARDRPLECFLWSVGLLPDPKYSNCRIELAKNIAILLVIDDIFDTYGKMDDLIIFTHAIRRWDLEAIETLPEYMKICYMALYNTTNETCYRVLKDTGRSVFPYFISTWVDMIEGFMVEAKWFNGGIAPNLEEYIENGVSTAGAYMALVYLFFLIGYGVTDQNASLLIRKPYPKLFSAAGRILRLWDDLGTAKEEEERGDLASSIHLFIKEKNLSTEEDARSRILEEIFRLWKDLNGELISDNKVLPLSIIKVALDMARSSQVVYKHEGDNYFSSVDNYVEALFFTPLVSS

SEQ ID NO: 174 - protein, 531 aa, Nepeta cataria
MAATTTSPNLAPVVHNNDHMLEIVESTKKREYLVEKITEKLTEASSEKLKLIDEIQRLGIGYHFEDVINSILQVQCSAFSTEEDLFTTALRFRLLRQAGFHVTPEVFTRVKDKSGNFKESLGGDTLGLLSLYEASHIGVDGERMLEDARQFTESYLRQSLAKLAPRLCSEVGQALEVPRHHRMVRLEARRFVQEYGKQSGHDRDLLELAILDYNQVQAQHNMELTEIVRWWKELGLVDKLSFARDRPLECFLWSVGLLPDPKYSNCRIELAKNIAILLVIDDIFDTYGKMDDLILFTHAIRRWDLEAMETLPEYMKICYMALYNTTNETCYRVLKETGRTVFPYFKSTWIDMIEGFMVEAKWFNGGIEPNLEEYIENGVSTAGAYMALVYLFFLIGEGVTDQNASLLIRKPYPKLFSAAGRILRLWDDLGTAKEEEERGDLASSIHLFIKEKNLSTEEDARSRILEEIFRLWKDLNGELISDNKVLPLSIIKVALDMARSSQVVYKHEGDTYFSSVDNYVEALFFTPLVSS

SEQ ID NO: 175 - protein, 510 aa, Nepeta cataria
MESTKKREYLLEKITEKLQKITEASEKLKLIDEIQRLGIGYHFEDVIDNILQVQCSAFSTEEDLFTTALRFRLLRQAGFHVTPEVFTRVKDKSGNFKESIGGDTPGLLSLYEASHIGVDGEKMLEDARQLTEFYLRQSLARLAPRPRGEVGQALEVPRHHRMVRLEARRFIEEYGKQSGHDRDLLELAILDYNQVQAQHNMELTEIVRWWKELGLVDKLSFARDRPLECFLWSVGLLPDPKYSNCRIELAKNIAILLVIDDIFDTYGKMDDLILFTHAIRRWDLEAMETLPEYMKICYMALYNTTNETCYRVLKETGRTVFPYFKSTWIDMIEGFMVEAKWFNGGIEPNLEEYIENGVSTAGAYMALVYLFFLIGEGVTDQNASLLIRKPYPKLFSAAGRILRLWDDLGTAKEEEERGDLASSIHLFIKEKNLSTEEDARSRILEEIFRLWKDLNGELISDNKVLPLSIIKVALDMARSSQVVYKHEGDTYFSSVDNYVEALFFTPLVSS

SEQ ID NO: 176 - protein, 542 aa, Phyla dulcis
MCMSSSVSLPTATTSSSVITGNDALLKYIRQPMVIPLKEKEGTKRREYLLEKTARELQGTTEAAEKLKFIDTIQRLGISCYFEDEINGILQAELSDTDQLEDGLFTTALRFRLLRHYGYQIAPDVFLKFTDQNGKFKESLADDTQGLVSLYEASYMGANGENILEEAMKFTKTHLQGRQHAMREVAEALELPRHLRMARLEARRYIEQYGTMIGHDKDLLELVILDYNNVQAQHQAELAEIARWWKELGLVDKLTFARDRPLECFLWTVGLLPEPKYSACRIELAKTIAILLVIDDIFDTYGKMEELALFTEAIRRWDLEAMETLPEYMKICYMALYNTTNEICYKVLKKNGWSVLPYLRYTWMDMIEGFMVEAKWFNGGSAPNLEEYIENGVSTAGAYMALVHLFFLIGEGVSAQNAQILLKKPYPKLFSAAGRILRLWDDLGTAKEEEGRGDLASSIRLFMKEKNLTTEEEGRNGIQEEIYSLWKDLNGELISKGRMPLAIIKVALNMARASQVVYKHDEDSYFSCVDNYVEALFFTPLL

SEQ ID NO: 177 - protein, 521 aa, Vitis vinifera
MSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIWGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEIVRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEDLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMH

SEQ ID NO: 178 - protein, 547 aa, Catharanthus roseus; identical to SEQ ID NO: 141

SEQ ID NO: 179 - protein, 526 aa, Olea europaea
MAENGAMYNYIRQPVIVTPEVDDGTKHSELVERTRRELQRSTKPVETLKLIDNLQRLGIAYYFEDDINAILDQFSDGLPDEDLFTTALCFRLLRDQRLQTGSDVFLKFMEKNMKFKEHLAQDTIGLVSLYEASSMGANGEEILSEAKEFTEMHLRQSMPQLAPQLRRQVSSALELPRHLRMARLEARRYIEEYGNESDHDPALLELARLDYNKVQLQHQMELAEITRWWKQLGLVEKLSFARDRPLECFLWTVGLLPEPKYSSCRIELAKTIAILLVIDDIFDTYGKMEELVLFTEAIQRWDLDELETLPPYMRICYMALYNTTNEICYKILKEYGFCVLPYLKSTWIDMIEGFMVEANWFNGGHGPNLEEYIENGVSTAGAYMALVHLFFLIGEGVTNENIAKLLRKPYPKLFSAAGRILRLWDDLGTAKEEEERGDLASCMQILMREKNIDCENEGRNYILKAINGLWKDLNDELISPNAMPLAITKVALNMARAFEVVYKHEEDSYFSSVDNYVQALFFTPIN

SEQ ID NO: 180 - protein, 504 aa, Valeriana officinalis
MIMELVEATRRTLRNESSDSTEKMRLIDSLQRLGLNHHFEQDIKEMLQDFANEHKNTNQDLFTTSLRFRLLRHNGFNVTPDVFNKFTEENGKFKESLGEDTIGILSLYEASYLGGKGEEILSEAMKFSESKLRESSGHVAPHIRRQIFQSLELPRHLRMARLESRRYIEEDYSNEIGADSSLLELAKLDFNSVQALHQMELTEISRWWKQLGLSDKLPFARDRPLECFLWTVGLLPEPKYSGCRIELAKTIAVLLVIDDIFDTYGSYDQLILFTNAIRRWDLDAMDELPEYMKICYMALYNTTNEICYKVLKENGWSVLPYLKRTWIDMVEGFMLEAKWLNSGEQPNLEAYIENGVTTAGSYMALVHLFFLIGDGVNDENVKLLLDPYPKLFSSAGRILRLWDDLGTAKEEQERGDVSSSIQLYMKEKNVRSESEGRQGIVEIIYNLWKDMNGELIGSNALPQAIIETSFNMARTSQVVYQHEDDTYFSSVDNYVQSLFFTPVS

SEQ ID NO: 181 - protein, 504 aa, Valeriana officinalis; identical to SEQ ID NO: 180

SEQ ID NO: 182 - protein, 507 aa, Valeriana officinalis; identical to SEQ ID NO: 143

SEQ ID NO: 183 - protein, 539 aa, Pogostemon cablin
MMSTSSLPVGNEALLKYIRQPVVLPTEEDESIKRRDYLLEKTARRLRTSTGSVEKLKLIDTIQRLGIDYYLEDDINVVLRNEYYNGRSSEEDLFTTALRFRLLRHNGFQISSDVFMKFKDKNGKFKKWIAEDTIGLLSLYEASYMGAHGEKILEEAMEFSRSLLKRSLPQLPPKLHGQVAQALELPRHLRMARLEARRFVQQYAKQSDCDRDLLNLATLDYNKVQLQHQFELAEITRWWQQLGLVEKLTFARDRPLECFLWTVGLLPEPRYSTCRIEMAKTIAILLVIDDIFDTYGKMDELLLFTQAIRRWDLEAMDILPEYMKICYMALYNTTNEICYKVLKLNGWSVLSYLKSTWIDMIEGFMVEAKWLNGGGAPNLEEYLENGVSTAGAYMALVHLFFLIGEGVNDQNAPLLTKKPYPKLFSAAGRILRLWDDLGTAKEEQERGDVASSIEFVMREKEVESEEEGRRYILGEIYELWKDLNGELMSKNGMPLAIIKVALNMARASQVVYKHEEDTYFSSVDNYVEALFFTPLPSSI

SEQ ID NO: 184 - protein, 543 aa, Picrorhiza kurrooa
MSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLII

SEQ ID NO: 185 - protein, 545 aa, Gentiana rigescens
MCMPIPTSTMSQPIATPLIKDNESLLRYLRQPMVLPHELDDDTKRRELVERTRRELQSMSKPLEAMKLIDTLDRLGIAYHFEDDINQSLTRFSSGQPNEDLLTTSLRFRLLRHNGHSISSEIFGKFLVQNGKFEESLGEEDILGLLSLYEASYMGGGEEKILMEAMEFSEAHLKSSIAKLTPQLSRQVAQSLELPRHRRMARLEARRYIEEYGKFENNYNPDLLELAKLDYNKVQSLHQMELSEITRWWKQLGLVDKLPFARDRPLECFLWTVGLMPEPKYSGCRIELAKTIAILLVIDDIFDTHGTIDELVLFTNAIRRWDLQAIEELPEYMRICYMALYNTTNEISYKILKENGWSVRPYLKETWIDMVDGFMMEASWFTNGQVPKMEEYLENGVTTAGSYMALVHCFFLIGKGVSEESVKLLMNPYPKLFSNAGRILRLWDDLGTAKEEQERGDLASSIVLFMKEKNITSDEEARESILKLIHNLWKEMNGELVSRNALPLEIKKVAFNMARASQVVYQHEEDSYFSSVDNYVKALFFTPLI

SEQ ID NO: 186 - protein, 541 aa, Camptotheca acuminata
MCTTLPSPATSTATIGDTDSLLKSQRQFTVYLPAHEADKDRKIEEIMEKTQGELEKTSDPTSVMKFIDTLERLGIAYHFEEEINSLLQGFLANGYSHYPQDLFTTALRFRLLRHNGYHISADVFQKFVDKNGKFKESLREDTQGMLSLYEASYLGANGEDILSQAMEFTETHFKQSIPLMAAVPQLEQALELPRHLRMARLEARRFIEEYIRESDHSSALLELAKLDYNKVQLLHQSELNEISRWWKQLGLVENLGFGRDRPLECFLWTVGILPEPKYSGCRIELTKTIAVLLVLDDIFDSFGTLDELVRFTHAIRRWDLSAMEQLPEYMKVCYMALYNTTNEIGYKILKEHGWNVVPYLKRTWIDMIEGFQAEANWCSSGYVPSLEEYIENGVTTAGSYMALVHLFFLMGQGVTDETIGMLEPYPKFFSSSGRILRLWDDLGTASEEQERGDIASSIELFMREKDLSSQGEARKYVKQVIYSLWKELNGELMASKAMPLPLIKAAFNMARTSQVIYQHGDDNSFPSVDQCVQSLFFTPIL

SEQ ID NO: 187 - protein, 535 aa, Osmanthus fragrans
MSPSVTPLIPTENDALYNYIRQPVIVTPEVDEGTKHRELLEKTRRELQRSTKPVETLKLIDKLQRLGIAYYFEDDINAILDRFSDCLPNEDLFTTALCFRLLRDNGYKTDSDVFLKFMEKNKKFKGHLAQDTIGLLSLYEASYMGANGEEILSEAKEFTEIHLRQSMPRLAPQLRRQVGSALELPRHLRMARLEARRYIEEYATESEHDPALLELARLDYNKVQLQHQMESTEISRWWKQLGLVEKLSFARDRFLECFLWTVGLLPEPKYSSCRIELAKTIAILLVIDDIFDTYGKMEELVLFTEAIQRWDLDELETLPPYMRICYMALYNTTNEICYKILKAYGFCVLPYLKSTWIDMIEGYMVEANWFNGGHGPNLEEYIENGVSTVGAYMALVHLFFLIGEGVTNENITKLLRKPYPKLFSTAGRILRLWDDLGTAKEEEERGDLASCMQILMREKNIYCENEGRKYILKAINSLWKDLNDELISPNAMPLAITKVALNMARASEVAYKHEEDSYFSSVYNYVQALFFTPIN

SEQ ID NO: 188 - protein, 507 aa, Artificial Sequence; identical to SEQ ID NO: 143
  source: /note="Description of Artificial Sequence: Synthetic polypeptide"

SEQ ID NO: 189 - protein, 525 aa, Phaseolus lunatus
MTQKVPSRTNPMMTSLEQIKIRIQEVLLKSNDSLETLKLIDNIQRLGIEHHFEEEINLQLGKVGNCNNSQDLSAAALQFRLLRHNGWSTSSDVFNNFLDKSGNFKESFNRDIWGMLSLYEASYFGAQGEEVLQHAMEFSRAHLHLSLPLLSPEVGRVIVEALKLPRHQRMSRLEAKNYMVQYSTESSQIPALLEFARIEYDTVQSMHQSELAEISRWWKNLGLIERLGFGRDGPRECFLWMLGVFPEPCYSHCRIELAKAICILQVLDDMFDTYGTLDELILFTEAVQRWDLDAMEKLPEYMKICYMALYNTTHEIAYRIQKDHGQTVVACLKRTWIDLLEAYLIEAKWFNNKYVPTFGEYLDNGVISSGSCLALVHATFLIGDNLSKETISMMSPYPRLFSCSGEILRLWDDLGTSKEEQKRGDNACSIQCLMKENYILDETFARKHIKQVLGNLWPELNGLVMATTTLPFSIRKASLNMARTSQFIYQHGDDQTMPTVNDLVKELLFTPSSKSGEESDTYCVV

SEQ ID NO: 190 - protein, 529 aa, Unknown
  source: /note="Description of Unknown: GES sequence"
MISTISQPTRKEPATTKPEIMEELHEGTRKELLTSSSPIATMKLIDSIQRLGVGYYFEEEINTLLDRFLDLETTEDLLATALRFRLLRDNCFPAHSDVFGKFMNKDGKFKESLRKDVWGLLSLYEASYLGTKDEVELVEAMEFTKTCLEEQSIPLMAHKLSRHVSQALDLPRHLRMPRLEARNYIHEYSLESNNSPPLLELAKLEFNAVQSLHQKELIEIVRWWKQLGLVDKLGFARDRPLECYLWTVGIFPEPYNSTCRIELTKTIAILLVIDDIFDTYGSLPDLILFTEAVRRWDLNAMESLPEYMKICYMALYNTTNDIGFMILKRHGLSIVPHLKRTWIDMFEAFLTEAKWFNSGYVPTLEEYLDNGVTTGGTYMALVHSFFLMGQGVNKETVTMMEPYPDLFSLSGRILRLWDDLGTAREEQERGDVACSIECLMREKRISCDDEGRKQVRQLIRSLWTELNGELIAPSAMPLSIINASLNLARTAQVVYQHGDDKKGSSVDNQVQALIYIPISFPKRRDLKLL

SEQ ID NO: 191 - protein, 513 aa, Vigna angularis
MAMKQNKLSIKSVAFRDKVPIQIDPGKKKLEQVKRSSQETLLNSSDPTKTLKIIDNIQRLGIGHHFEEEINVKLGKVADCDFSQDLCSTALQFRLLRHNGCHASSDVFKKFLDHSGNFKESITTDIWGMLSMYEASYLGAKGEEVLQQAMDFSSAHLQQSLPLLSPDVGNHVVRALTLPRHLRMSRLEARNYIEEYSQVSSKMPYLLEMAKIDNAMVQSMHQKELADISRWWKDLGLVERLGFARDKPAECFLWTVGVFPEPCYSNCRIELAKTICILLVMDDIFDTYGTSDELVLFTEAIKRWDLDAMEQLPEYMKISYLALYNTIQEIACRIQMEHGQTVLSCLKRTWIDIFEAFLKEAKWFSNKYVPTFEEYLANGVISSGSYMALVHATFLIGDGISKETISLMNPYPRLFSCSGEILRLWDDLGTSREEQERGDNACSLQCLMTENNISDEIVARKQIRGFIRNLWPELNSLALTTASLPFSVIKASLNMARTSQVIYQNGDDQNTFT

SEQ ID NO: 192 - protein, 466 aa, Vitis vinifera
MSEADSSTRRMKEVKERTWEAFYRAWDSRAAMEMVDTVERLGLSYHFEDEINALLQRFCDWNASEDLFTTALRFRLLRQNGFPTHSASDVFGKFMDKNGKFKESLTEDIWGMLSLHEASHLGAKNEEVLAEAKEFTRIHLIQSMPHMEPHFSSHVGRALELPRHLRMARWWKQLGLVDKLDFARDRPMECFLWTVGIFPDPRHSSCRIELTKAIAILLVIDDIYDSYGSLDELALFTDALPEYMKICYMALYNTTNDIAYRILKEHGWSVIEDLKRTWMDIFGAFLAEAYCFKGGHVPSLEEYLTNAVTTGGTYMALVHAFFLMGQGVTRENMAMLKPYPNIFSCSGKILRLWDDLGTARVGDNASSIECYKREREREMDTVLEDEACRKHIRQMIQSLWVELNGELVASSALPLSIIKAAFNLSRTAQVIYQHGDDNKTSSVEDHVQALLFRPVSSNGHAQITMH

SEQ ID NO: 193 - protein, 537 aa, Coffea arabica
MCMPTPTATQPIATPLIRDNESLLKYLRQPSVLPHEVDDSRKELLGRTRRQLRSTSEPLKAMNLIDTLQRLGLAYHFEDDMNAILSQLSSSGQSDGDLLTTALRFRLLRHNGHKIVQKFMDKNGKFKDSLKEDTMGLLSLYEASHLAANGEDILLEAMELTEAHLKQSLPSLPTQLARKVSSALELPRHRRMARLEARRYIQEYSEEIGHDPNLLELAKLDYNKVQSLHQMELTEISRWWKQLGLVDKLTFARDRPLECFLWTVGILPEPKYSNCRIELAKTIAILLVIDDIFDTHGTIDELVLFTNAIRRWDLEAMEGLPEYMRICYMALYNTTNEICYKILKENGWSVLPYLKATWIDMIEGFMLEASWYNNGQVPNMEEYVENGVTTAGAYMAMVHLFFLIGQGVTEENVKLLMKPYPKLFSCSGRILRLWDDLGTAKEEQERGDLASSIQLFMRENNITCDEEGRKRILQLIDNLWKDLNWELVSRDAMPLAIIKAAFNMARSSQVVYQHEEESYFSSVDNYVESLFFTPIIN

SEQ ID NO: 194 - protein, 541 aa, Coffea canephora
MCMPTPTATQPIATPLIRDNESLLKYLRQPSVLPHEVDDGRKELLGRTRRELRSTSEPLKAMNLIDTLQRLGLAYHFEDDMNAILSQLSSSGQSDGDLLTTALRFRLLRHNGHKISSDIFQKFMDKNGKFKDSLKEDTMGLLSLYEASHVGANGDDLLLEAMEFTEAHLKQSLPSLPTQLARKVSSALELPRHRRMARLEARRYIQEYSEEIGHDPNLLELAKLDYNKVQSLHQMELTEISRWWKQLGLVDKLTFARDRPLECFLWTVGILPEPKYSNCRIELAKTIAILLVIDDIFDTHGTIDELVLFTNAIRRWDLEAMEGLPEYMRICYMALYNTTNEICYKILKENGWSVLPYLKATWIDMIEGFMLEASWYNNGQVPNMEEYVENGVTTAGAYMAMVHLFFLIGQGVTEENVKLLMKPYPKLFSCSGRILRLWDDLGTAKEEQERGDLASSIQLFMRENNITCDEEGRKRILQLIDNLWKDLNWELVSRDAMPLAIIKAAFNMARSSQVVYQHEEESYFSSVDNYVESLFFTPIIN

SEQ ID NO: 195 - protein, 529 aa, Glycine soja
MAFSEKVPSQTYYPGMKDFDQVKRKSQEALLNSSDSLRTLEIIDTIQRLGIEHHFEKEINLQLGRIGDWNAAEDLFATSLQFRLLRHYGWPTCSDVFNKFLDQSGNFKESVTRDIWGMLSLYEASYLGAKGEEVLQQAMDYSRAHLCQSLSDLSPKVGSIVVEALKLPRHLRMGRLEAKNFMVEYSQASNQIPALLELARLDYDMIQSMHQKELAEISRWWKELGLIERLGFGRDGPRECFLWVLGIFPEPRYSNCRIELAKAICILQVLDDMFDTYGTLDELILFTKAIKRWDLDVMEQLPEYMKICYMALYNTTHEIAYKIQKDHGQTVVACLKRTWIDLIEAYLKEAKWFNNKYVPTFQQYLDNGVISSGSYLALVHASFLIGDDFSKETISMMNPPYPRLFSCSGEILRLWDDLGTSRDEQERGDNACSIQCLMTENNISDENVARRHIRKLIKNLWPELNGLTMITTTLPLSVMRASLNMARTSQVIYQHGDYQSMLTVDDHVQALLLTPSINYQDESDINHVI

SEQ ID NO: 196 - protein, 518 aa, Glycine soja
MAFNDNKVPSQIDLRTNNFEQVKRNSQMALLNSSDPIKILKMIDTIQRLGIEHHFKEEINVQLGKVGDWDVTQDLFGTALQFRLQRHNGWPSCSDVFKKFLDKSGTFKESITNDIWGMLSLYEASYLGAKGEEVLQQAMDFSKAHLHQSLPHLSPELRKLVAKALTLPRHLRMGRLEARNYMEKYSQATNQIPALMELAKLDFAMVQSMHQKELAEISRWWKNLGLVERLGFARDRPAECFLWTVGTFPEPRYSNCRIELTKTICILLVMDDIFDTYGTLEELVLFTEAIKRWDLDAMEQLPEYMKICYMALFNTTHEIAYKIQKEHGQTVVACLKRTWIDIFEAFLKEAKWFNNGYIPTFKEYLDNGVISSGSYMALVHATFLIGDSLSKETISIMKPYPRLFSCSGEILRLWDDLGTSREEQERGDNACSIQCLMTENNLSDENVARKHIRQLIQNLWPELNGLAMTTTALPSSVMKASLNMARTAQVIYQHGDDQNTFTVDDYVKTLILTPSSNY

SEQ ID NO: 197 - protein, 491 aa, Vigna angularis
MTQTIPTMTSLEQLKIKSQEVLLDSSDSLRTLKLIDTIQRLGIDHHFEEEINLQLGRVADCNNAQDLFATALQFRLLRHNGWSTSSDVFNKFLDKSGNFKESVTGDVWGMLSLHEASYLGAEGEEVLQHAMECSRAHLHQSLPHLSPEVGRVVVEALKLPRHQRMVRLEAKNYMVQYSKESSQIPALLELARLDYDMVQSMHQKELAEISRWWKDLGLIERLGFGRDGPRECFLWALGVFPEPRHSNCRIELAKAICILQVIDDMFDTYGTLDELILFTEAVQRWDLDAMEKLPEYMKICYMALYNTTHEIAYRIQRDHGQTVVASLKRTWIDLLEAYLKEAKWFNDKYVPAFEEYLDNGVISSGSCLALVHATVLIGENLSRETISLMSPYPRLFTCSGEILRLWDDLGTSKHIRRLLGNLWPELNGLAMATTTLPSAVTKASFNMARTSQFIYQHGDDQQMPTVDDLVQALLFTPSDKYGEESDINCVV

SEQ ID NO: 198 - protein, 433 aa, Glycine max
MAFNDNKVPSQIDLRTNNFEQVKRNSQMALLNSSDPIKILKMIDTIQRLGIEHHFKEEINVQLGKLGDWDVTQDLFGTALQFRLQRHNGWPSCSDVFKKFLDKSGTFKESITNDIWGMLSLYEASYLGAKGEEVLQQAMDFSKAHLHQSLPHLSPELRKLVAKALTLPRHLRMGRLEARNYMEKYSQATNQIPALMELAKLDFAMVQSMHQKELAEISRWWKNLGLVERLGFARDRPAECFLWTVGTFPEPRYSNCRIELTKTICILLVMDDIFDTYGTLEELVLFTEAIKRWDLDAMEQLPEYMKICYMALFNTTHEIAYKIQKEHGQTVVACLKRTWIDIFEAFLKEAKWFNNGYIPTFKEYLDNGVISSGSYMALVHATFLIGDSLSKETISIMKPYPRLFSCSGEILRLWDDLGTSRVLIHLDTHLFPS

SEQ ID NO: 199 - protein, 542 aa, Cajanus cajan
MSSMFQPRNLSLKTSRPPMIYNNLSIKSIAFRDKVPSQTDPSTRNLEQVKRRSQELLLNSRDPIKTLKIIDNIQRLGIGHHFEEEINVQLGRVGDWDVTQDLLATALQFRLLRHNGWPARSDAFKKFLDNTGNFQESITNDIRAMLSLYEASYLGAKGEEILQQAMDFSTAHLHQSLPHLSPELGRIVARSLTLPRHLRMARLEAKNYMEEYSQASSQIPSLLELAKLDHVMVQMMHQKELAEISGWWKKLGLVERLGFARDRPEECFLWTVGVFPEPYYSTCRIELTKTICILLVMDDIFDTYGTLDELILFTKAIKRWDLDAMEQLPEYMKICYIALYNTTHEIANKIEKAHGESVVACLKRTWTDIFEAFLKEAKWFNNKYIPTFREYLDNGVISSGSYMAMVHATFLVGDGLSKETISMMKPYPRLFSCSGEILRLWDDLGTSREEQERGDNACSIQCFMTENNISDENVARKHIRELIRNLWPELNGLAMTTSALPLSVMKASLNMARTAQVIYQHGDEQNAFTVDDYVKTLLFTQH

SEQ ID NO: 200 - protein, 626 aa, Cajanus cajan
MLQTLRPGTMRTKLSIKSISLPDQFGPRVIYTRPVGFLPINHEFGLSSSYLYSANRIFTDQSRVWSVFELFILAQSDFYRSITSLVFELFILAQSEFCRQSRVCLRVIYTHPIELLPTITSLYGKKSLEQLKRSSQEALLNTSDSLRTLKTIDTIQRLGIEHHFKEEINLQLGRLTNWEPVENLFATALQFRLLRHNGWPTRSDVFNKFLDKSGNFKESVTKDIWGMLSLYESSYLGTKDEEVLQQAMDFSRAHLHRSLPYLSLEVKNIVGGALMLPRHLRMARLEAKNYMVECRKTSSQIPDLLKLARLDFDISQSMHQKELAEISRWWKNLGLVESIGFGRDKPGECFLWVLGILPEPCYSNCRIELAKAISVLQVMDDMFDTHGKLDELVPFTMAIRRWDLDAMEQLPEYMKICYMALYNTIHEIAYRIQKEHGKTVITCIKRTVHIFEAYLKEAKWFNNKYVPTFREYLDNGVISSASFMALVHSTLLIGDNLSEKTISMMIPYPRIFSCSGEILRLWDDLGTSRDEQKRGDNACSIQCLMAENNISDENVARKHIRKLIGNLWLELNGLALTTTDFPLSVARTSLNMARAAQAIYQHGDDQSSLTVDDQVQALLFTPSANY

SEQ ID NO: 201 - protein, 521 aa, Vitis vinifera
MSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMH

SEQ ID NO: 202 - protein, 523 aa, Vitis vinifera
MSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIWGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEIVRWWKQLGLVDKLDFARDRPMECFLWTVGIFPDPRHSSCRIELTKAIAILLVIDDVYDSYGSLDELALFTDAVKRWDLGAMDQLPEYMKICYMALYNTTNDIAYRILKEHGWSVIEDLKRTWMDIFGAFLAEAHCFKGGHVPSLEEYLNNAVTTGGTYMALVHAFFLTRQGVTRENMAMLKPYPNIFSCSGKILRLWDDLGTAREEQERGDNASSIECYKREREREMDTVLDDEACRKHIRQMIQSLWVELNGELVASSALPLSIIKAAFNLSRTAQVIYQHGDDNKTSSVEDHVQALLFRPVSSNGHAQITMH

SEQ ID NO: 203 - protein, 518 aa, Glycine max
MAFNDNKVPSQIDLRTNNFEQVKRNSQMALLNSSDPIKILKMIDTIQRLGIEHHFKEEINVQLGKLGDWDVTQDLFGTALQFRLQRHNGWPSCSDVFKKFLDKSGTFKESITNDIWGMLSLYEASYLGAKGEEVLQQAMDFSKAHLHQSLPHLSPELRKLVAKALTLPRHLRMGRLEARNYMEKYSQATNQIPALMELAKLDFAMVQSMHQKELAEISRWWKNLGLVERLGFARDRPAECFLWTVGTFPEPRYSNCRIELTKTICILLVMDDIFDTYGTLEELVLFTEAIKRWDLDAMEQLPEYMKICYMALFNTTHEIAYKIQKEHGQTVVACLKRTWIDIFEAFLKEAKWFNNGYIPTFKEYLDNGVISSGSYMALVHATFLIGDSLSKETISIMKPYPRLFSCSGEILRLWDDLGTSREEQERGDNACSIQCLMTENNLSDENVARKHIRQLIQNLWPELNGLAMTTTALPSSVMKASLNMARTAQVIYQHGDDQNTFTVDDYVKTLILTPSSNY

SEQ ID NO: 204 - protein, 481 aa, Lupinus angustifolius
MCSTKSLEQVKRKIQETLLNSDRLGTLKIIDSIQHLGIGHHFEEEINALLGRVLDYDTAHDLFATSLHFRLLRHNGFPTSSDIFKKFCDKSGYFKESLSKDIWGMLSLYEASYLGAEGEELLHKAMDFSKVHLHNSISQLGPQVSMHIARSLILPRHLKMAKLEAKNYIHEYSHASNQIPALLELAKLDYDMAQSLHQRELAEICRQATLLLWWKELGLVGRLGFGRDRPAECFLWTLGIFPEPSYSNCRIELTKTICILLVMDDIFDTYGSLDDLILFTDAIRRIQKEHGVTVVAHLKRTWIDIFEAFLEEAKWFNKGYMPTFREYLNNGVISAGSYMAMVHATFLIGDGNSKENISMMKPYPRLFSCSGEILRLWDDLGTSTEEQERGDNACSIQCHMRENNISDENEARKHIREFIGKLWQELNGIAMNTNLPWSIVKASLNMARTAQVIYQHGDDKSTYSVDEYVQTLLFTPSPRNS

SEQ ID NO: 205 - protein, 545 aa, Handroanthus impetiginosus
MCSGVAPTSTTPIRINSSLQSTIPISPKLKQQQLRKVDLEYTKTNEELREKTRGTLQKALDPMAAMKLIDTLQWLGISYHYEEEIDFWLGKLSQWDADDDDLHATALRFRLLRQNARPVSSDVFKKFRVNGKFRKSISEDKEGLLNLYEASCLGTNGEDILSEAAKFTENELKLSSANGILPKHISRRVGRALELPRHMRMERLESRLYIDEYNIQENHSLLLLEQAKADYNEVQLLYQSELAEMSRWWKQLGLVEKLTFARDRPMECFLWTVGIFPEPKYSSLRVDLAKTVAILLVIDDIFDTYGTINELSLFKSAIQRWDLDAIEQLPQYMKICYMALYNTTNEIAYKVLREQGRNILPFLEKAWIDAIEAFMIEAEWFNNGHTPRVEDYLENGVTTSGAYMALVHAFFLMGEGLTIENVKLMAKPYPKLFSNSGRILRLWDDLGTAKEEQEKGDNASSISLLMKEKNMAHEDEARAYTMKLIHNLWKDLNTELLGSNMLPLPIIRACFNMSRTSQVIYQHQEDSYFSSVDKFVDLILFKPIA

SEQ ID NO: 206 - protein, 545 aa, Handroanthus impetiginosus
MCSGVAPTSTTPIRINSSLQSTIPISPKLKQQQLRKVDLEYTKTNEELREKTRGTLQKALDPMAAMKLIDTLQWLGISYHYEEEIDFWLGKLSQWDADDDDLHATALRFRLLRQNARPVSSDVFKKFRVNGKFRKSISEDKEGLLNLYEASCLGTNGEDILSEAAKFTENELKLSSANGILPKHISRRVGRALELPRHMRMERLESRLYIDEYNIQENHSLLLLEQAKADYNEVQLLYQSELAEMSRWWKQLGLVEKLTFARDRPMECFLWTVGIFPEPKYSSLRVDLAKTVAILLVIDDIFDTYGTINELSLFKSAIQRWDLNAIEQLPQYMKICYMALYNTTNEIAYKVLREQGRNILPFLEKAWIDAIEAFMIEAEWFNNGHTPRVEDYLENGVTTSGAYMALVHAFFLMGEGLTIENVKLMAKPYPKLFSNSGRILRLWDDLGTAKEEQEKGDNASSISLLMKEKNMVHEDEARAYTMKLIHNLWKDLNTELLGSNILPLPIIRACFNMSRTSQVIYQHQEDSYFSSVDKFVDLILFKPIA

SEQ ID NO: 207 - protein, 491 aa, Lactuca sativa
MALMTDSNPIILMELVDKIQRLGLGCTFEEDINKIMKYLVQGHPNDDLYTVSLRFRLLRHNGLHVNPDVFGSFMDANGKFKESLSEDIEALLSLYEASYMGADGEDILSEAREFTTRHLKKSVFKLTPLLRNKVLQSLKLPRHLRMERLEARMYIEEYGNEQDHIPILLELAKLEYNEIQILHQMEISEITRWWKHLGLTDKLPFARDRPLECFLWTVGLLPERKYSTKRIEVAKTISILLVIDDIFDTYGSYDDLVLFTKAIQRWDMQEIEQLPEYMKICYMALCNTTNEICYEILKEHGLNVLPFLRKTWIEMVEAFMVEAEWVKRGTEPNLKDYIENGVKTAGTYMALVHLFFLIGEGVTPENMRTLTDSYPSFFSISGTILRLWDDLGTSKEEQERGDVASSIQLLMKEKNITCEEEGRKYILQFIDSSWKELNKTLVVPNTLPISIIRIALNMARASQVVYQHEESSYFSRVDNHVKSLFFAPIQI

SEQ ID NO: 208 - protein, 533 aa, Parasponia andersonii
MSMQSSKPETQHHDSLLKSLLLQHGVVTDHDDSSSTKSTSEEHFVKVQKALRKPSTQRTKMRLIDSIQRLGVGHHFEEIKQILEGFSDLNSSEDNLFDTALRFRLLRHNGLPTSSDVFDQFINKEGEFKESLSQDTCGMLSLYEASYLGAKGEDKLHKAMEFTRSHLKQSMSSVSPELQTQVAKALELPRHLRMATLEARNYIDEYSQESNHNSALLALAKLEFNELQSLHKRELTEIIRWWKQLGLVDKLGFGRDRPCECFLWTVGILPEASYSSIRVELAKTISILLVIDDIYDTYGSLDELVLFNEAIRRWELGAMDMLLEYMKICYMALYNTTNEIGYRVLKEHGWCITEHLKRTWIDIFEAFLTEAEWFNKKHTPTLEPYLTNGVTSGGSYMALVHSFFLIGHDLTDETISLMQPYPELFSCSGKILRLWDDLGTAKEEQERGDVASSIECYMREKNIEFEDEARKHIRELIRSLWMELNGELRASSALPRSITKACIDLARTAQVIYDQSFFNVEDHVQSLFFRPYN

SEQ ID NO: 209 - protein, 545 aa, Trema orientalis
MCQTGSPLSMQSSKPETQHHDSLLKSLLLQHGVVADHHDSSNTKSTSEELFVKVQKVLRKPSTQRTKMRLIDSIQRLGVGHHFEEEIKQILEGFSDLNSSEDNLFDTALRFRLLRHNGLPTSSGVFDQFINKEGEFKESLNQDTCGMLSLYEASYLGAKGEDKLHKAMEFTRSHLKQSMSSVSPELQTQVTKALELPRHLRMATLEARNYIDEYSQESNHNSALLALAKLEFNELQSLHKRELAEIIRWWKQLGLVDKLGFARDRPFECFLWTVGIFPEASYSSIRVELAKTISILLVVDDIYDTYGSLDELVLFNEAIRRWELGAMDKLPEYMKICYMALYNTTNEIGYRVLKEHGWCITEHLKRTWIDIFEAFLTEAEWFNKKHTPTLEPYLTNGVTSGGSYMALVHSFFLIGHDLTDENISLMRPYPELFSCSGKILRLWDDLGTAKEEQERGDVASSIECYMREKNIELEDEARKHIRGLIRSLWMELNGELRAPSALPRSITKACFDLARTAQVIYQHGDDQSFFNVEDHVQSLFFRPCN

SEQ ID NO: 210 - protein, 535 aa, Unknown
  source: /note="Description of Unknown: GES sequence"
MASAVPLSSTPLINGDNSPLKNTHQHVEERSSKRREYLLEETARKLQRNDTESVEKLKLIDNIQRLGIGYYFEDAIDAVLRSPFSAEEEEDLFTAALRFRLLRHNGIQVTPEIFLKFKDERGEFDESDTLGLLSLYEASNLGVTGEEILEEAMEFAEPRLRRSLSELAAPLRSEVAQALDVPRHLRMARLEARRFIEQYGKQSDHDGDLLELAILDYNQVQAQHQSELTEITRWWKQLGLVEKLGFGRDRALECFMWTMGILPHPKYSSSRIESAKAAALLYVIDDIFDTYGKMDELILFTDAIRRWDLEAMEGLPEYMKICYMALYNTTNEICYRVLKDTGRIALPYLKSVWIETIEAYMVEVKWFSGGSAPKLEEYIENGASTVGAYMVLVHLFFLIGEGLTHQNVLFFKQKPYHKPFSAAGRIFRLWDDLGTSQEEEERGDMASSIRLFMKEYKLSTVEEARSCVLEEISRLWKDLNEGLISIKDALPLTIVKVALNIARTSQVVYKHEQHTYMLSVDNYVEALFFTPLLSS

SEQ ID NO: 211 - protein, 505 aa, Unknown; identical to SEQ ID NO: 142
  source: /note="Description of Unknown: GES sequence"

SEQ ID NO: 212 - protein, 529 aa, Ricinus communis; identical to SEQ ID NO: 190

SEQ ID NO: 213 - protein, 537 aa, Medicago truncatula
MLQKSSSRIMHSKLSIKSIALNEKLSPLQTEDKTKSLGQVKRRSREALVNSNDPIVTLKMIDSIQRLGIGHHLEDEINIQLGRICDWDLSQDLFATSLQFRLLRHNGWTTCSDVFRKFLDKSGNFNESLTKDVWGMLSLYEASYLGTEDEEILKKAMEFSRARLSELIPHLSPEVGRNIAKSLTLPKHLRMARLEARNYMEEYSKGSNQIPALLELAKLDSDMVQSLHQRELAEICRWWKELGLVEKLGFARDRPTECFLWTVGIFPEPCHSNCRIELTKTICILLVMDDIFDTYGTLDELVLFTKAIKRWDLDAMDQLPEYMKICYMALYNTTNEIAYKIQKEHGLTVVSYLKRTWIDIFEAFLEEAKWFNNGCVPNFKTYLDNGVISAGSCMALVHATFLIGDGLSKETMSIMMKSYPRLFTCSGEILRLWDDLGTSTEEQERGDNASSIQCMMRENNISDENEGRIHIRMLLGNLWRELNGLATTKTIPLSVVKASLNMARTAQVIYQHGDDQSTFTVDDYVQTLIFTSLPTSH

SEQ ID NO: 214 - protein, 544 aa, Cicer arietinum
MSSTYRSRFLSLQKSKLGTMHCKFSIKSSALNDKVVPLQSDDRSKSLEQVIRKSREVLLKSNDPIATLKMIDSIQGLGISHHFEDEINIQLGRICNWDASQDIFATSLQFRLLRHYGYPTTSDIFRKFLDKSGNFKESFTKDIWGMLSLYEASYLGTEDEEVLKKAMEFSKTHLNELIPNLAPEVGSHIARALTIPKHLRMVRLEARNYMEEYRQATDQIPAFLELAKLDSQIIQSLHQRELEEILRWWKELGLVDRLGFARDRPKECFLWTVGIFPEPYYTNCRIEITKTICILDIIDDIFDTYGTLHDLVLFTKAIKRWDLNAMEQLPEYMKICYMALYNTTNEIAYRIQKEQGLTVVSYLKRTWIDMFDAYLEEAKWFNSRYVPSFKTYLDNGVISSGSCMVLVHATFLIGDDLSKETISMMNSYPRLFSCTGEILRLWDDLGTSKDEQERGDNACSIQCLMKENNILDENVARKNIRLLIGKLWRELNGLAMTKTVPLSIVKASLNMARTSQVIYQYGDDKSTFTVDECVQTLIFTSLPR

SEQ ID NO: 215 - protein, 531 aa, Glycine max
MAFSEKVPSQTYYPGMKDFDQVKRKSQEALLNSSDSLRTLEIIDTIQRLGIEHHFEKEINLQLGRIGDWNAAEDLFATSLQFRLLRHYGWPTCSDVFNKFLDQSGNFKESVTRDIWGMLSLYEASYLGAKGEEVLQQAMDYSRAHLCQSLSDLSPKVGSIVVEALKLPRHLRMGRLEAKNFMVEYSQASNQIPALLELARLDYDMIQSMHQKELAEISRWWKELGLIERLGFGRDGPRECFLWVLGIFPEPRYSNCRIELAKAICILQVLDDMFDTYGTLDELILFTKAIKRWDLDVMEQLPEYMKICYMALYNTTHEIAYKIQKDHGQTVVACLKRTWIDLIEAYLKEAKWFNNKYVPTFQQYLDNGVISSGSYLALVHASFLIGDDFSKETISMMNPPYPRLFSCSGEILRLWDDLGTSRDEQERGDNACSIQCLMTENNISDENVARRHIRKLIKNLWPELNGLSMTTTTTTLPLSVMRASLNMARTSQVIYQHGDYQSMLTVDDHVQALLFTPSINYQDESDINHVI

SEQ ID NO: 216 - protein, 528 aa, Glycine max
MSVAFSDKVPSQTYLGTKDLDQVIRKGQEALLNSSDPLRTLKIIDTIQKLGIEHHFEKEINLQLGRVGDWDTAEDLFATALQFRLLRHNGWPTCSDVFNKFLDKSGNFKESVTRDIWGMLSLYEASYLGAKGEEVLQQAMDYSRAHLCQSLPHLSPKVRSIVAEALKLPRHQRMVGLEAKNYMVEYSQASNQIPALLELARLDYDMIQSMHQKELAEISRWWKDLGLIERLGFGRDGPRECFLWALGIFPEPRHSSCRIELAKAICVLQVIDDVFDTYGTLDELVLFTKAIKRWDLDAMEQLPEYMKICYMALYNTTHEIAYKIQKDHSLTVVACLKITWIDLIEAYLKEANWFNNKHVPTFQQYLDNGVISSGSYLALVHATFLIGDDLSKETIFMMNPYPRLFSCSGKILRLWDDLGTSRDEQERGDNACSIQCLMKQNNISDENVARKLIRQLIDNLWPELNGLTMTTNLPLSVMRASLNMARTSQVIYRHGDDQNMPTVDEHVQTLLFTPSINYRDENDINHVI

SEQ ID NO: 217 - protein, 519 aa, Phaseolus vulgaris
MSQTNSTITSLEQLKIRSQKVLLNSSDSLRTLELIDTIQRLGIEHHFEEEINLQLGRVGDCNNAKDLFATSLQFRLLRHNGWSTSSDVFNNFLDKSGNFKESVTRDIWGMLSLYEASYFGAQGEEVLQHAMEFSMAHLHQSLPLLSPYVGKVIVEALKHPRHQRMSRLEARNYMVKYSKESNQILALLEFARLEYDTVQSMHQKELAEISRWWKNLGLIERLGFGRDGPRECFLWMLGIFPEPCYSNCRIELAKAICILQVLDDMFDTYGTLDELILFTEAIQRWDLDAMGKLPEYMKICYMALYNTTHEIAYNIQKDHGQTVVACLKKTWIDLLEAYLIEAKWFNKKYVPAFGEYLDNGVISSGSCLALVHATFLIGDNLSKETISMMSPYPRLFSCSGEILRLWDDLGTSKEEQKRGDNACSIQCLMKENDISDETFARKHIRQVLGNLWSELNSLVMATTTLPFTIRKASLNMARTSQFIYQHGDDQTMPTVNDLVKLLIFTPSKSGEESNTNCVV

SEQ ID NO: 218 - protein, 524 aa, Phaseolus vulgaris
MQKMPSQTNPMTTSLEQLKIKSQEVLLNSSDSLRTLKLIDTIQRLGIEHHFEEEINLQLGKVKDCNNAKDIFATALQFRLLRQNGWSTSSDVFNKFLDKSGNFKESVTRDIWGMLSLYEASYFGAQGEEVLQRAMEFSMAHLHQSLPLLSPEVGRVVVEALKLPRHQRMSRLEAKNYMVQYNKESSQIPALLQFARLEYDTLQLIHQNELVEISRWWKNLGLIERLGFGRDGPRECFLWMLGVFPEPCYSNCRIELAKAICILQVLDDMFDTYGTLDELILFTEAVQRWDLDAMEKLPEYMKICYMALYNITHEIAYKIQKDHGQTVVACLKKTWIDLLEAYLIEAKWFNNKYVPTFGEYLDNGVISSGSCLALVHATFLIGDNLSKETISMMSPYPRLFSCSGEILRLWDDLGTSKEEQKRGDNACSIQCLMKENDISDETFARKHIRQVIGNLWSELNSLVIATTTLPFTIRKASLNMARTSQFIYQHGDDQTMPTVNDLVNVLLFTPSSKSREESDTNFVV

SEQ ID NO: 219 - protein, 533 aa, Phaseolus vulgaris
MCKTSTPTIMQLSINSLPLTQKVPSLIDLGTKRMEQVKRRSQETLLNSSDPIKTLKIIDTIQRLGIGHHFEEEINVKLGKLRDWDFSEDLFSTTLQFRLLRNNGWPTSSDVFKKFLDKSGNFKESITNDIWGMLSMYEASYLGAKGEEVLEKAMDFSTAHLHQSLQHLSPDVGNLVARALTLPRHLRMSRLEARNYIKEYSQVSSHMPYLLEMAKIDYAMLQSMHQKEFAEISRWWNKLGLAERLGFARDKPAECFLWTMGIFPEPCYSNCRIELTKTICILLVMDDIFDTYGTLDELILFTKAIKRWDLDAMEQLPEYMKISYLALYNTTHEIAYKIQMEHGQNVISSLKRTWIDIFEAFLKEAKWFNNKYVPTFQEYLDNGVISSGSYMALVHATFLIGDGLSKETISMMNPYPRLFSCSGEILRLWDDLGTSKEEQERGDNACSIQCLMIENNISDENVARKHIRRFIRNLWPELNSLVLTTTSLPFSIMKASLNMARTAQVIYQHGDDRNTFTVDDYVQTLLFTPSANY

SEQ ID NO: 220 - protein, 570 aa, Morus notabilis
MEAYSPKKKLNFARHSDSLSCKCQSQLSPTTQPSTLEISHNETLLKSLVLHQEVVSNQAYHHEHDPSSVSSTSDELIAKIKKALREPSSQRAKMKLVDVIQRLGVGHHFEKEIRLLLEGFLDYNSNEGLYDAALRFRLLRHNGLPTSSDVFDKFMNNKGDFKESLRQDIWGMLSLYEASYLGAKGEDKLLKAMEFTRSHLKQSLPSLPPQLQTQIAKSLELPRHLRMATLEARNYIDEYSQESNHSLALLELAELEFSELQSLHRKELAEIIIWWKQLGLVEKLGFARDRPFECFLWTVGVFPEASYSNIRIELAKTVCILLVLDDIYDTYGSLDELILFNDAIKRWELSAMEQLPAYMKICYMALYNTTNEIAYRVLKEHGWCISAHLKRTWIDIFEAFLTEAEWCNRRYTPTLEQYLTNGVTSGGSYMALVHSFFLIGHDVTDETVSMMEPYPELFSCSGKILRLWDDLGTAKEEQERGDVASSMECYMKENNVELEDEARKHIKKMIGNLWMELNEHLMAPSALPRSITKACFNLARTAQIIYQHGDDETFFSVEDHVQSLFFTPCK

SEQ ID NO: 221 - protein, 523 aa, Vitis vinifera
MSEADSSTRRMKEVKERTREAFYRAWDSRAAMEMVDTVERLGLSYHFEDEIKALLQRFCDWNSSEDLFTTSLRFRLLRQNGFPTHSDVFGKFMDKNGKFKESLTEDIWGMLSLHEASHLGAKNEEVLAEAKEFTRIHLIQSMPHMEPHFSSHVGRALELPRHLRMARLEVRNYIGEYSRESNPNLALLELAKLDFDMVQSLHQKELAEIVRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHRWSVIEDLKRTWMDIFGAFLAEAHCFKGGHVPSLEEYLNNAVTTGGTYMALVHAFFLMGQGVTRENMAMLKPYPNIFSCSGKILRLWDDLGTAREEQERGDNASSIECYKREREREMDTVLDDEACRKHIRQMIQSLWVELNGELVASSALPLSIIKAAFNLSRTAQVIYQHGDDNKTSSVEDHVQALLFRPVSSNGHAQITMH

SEQ ID NO: 222 - protein, 553 aa, Sesamum indicum
MCMSSSSSSSMPMSVPTAAPMITANGALLKYIRQPTLFPVEQDEGSKRRDYLLGKVGMQLQSAAAAVEKLKLIDTIQRLGIAYYLEDGINAILQAEFSNALSTDDDLFTTALRFRLLRHNGFQISPDVFLKFMDKNGQFKESLTDDKLGLLSLYEASYLGSNGEEILEKAMELTKTHLQRSLPQLPPQLQGQVAQALELPRHLRMARLEARRYIDQYAAQSDCDQELLELAILDYNKVQAQHQMELAEITRWWTQLGLVDKLTFARDRPLECFLWSVGLLPEPKYSTCRIELAKTIAILLVIDDIFDTYGKMDELLLFTDAIRRWDLEAMETLPEYMKICYMALYNTTNEICYKVLKENGWSVLPYLKSTWIDMIEGFMVEAKWFNGGSAPNLEEYIENGVSTAGAYMALVHLFFLIGEGVTDHNARLLFKPYPKLFSAAGRILRLWDDLGTAKEEEERGDLASSIHLLMREKKLATEEEGRSRILEDIYGLWKDLNGELIAKNGMPLAIIKVALNMARASQVVYKHDEDTYFSSVDNYVEALFFTPLSFTYN

SEQ ID NO: 223 - protein, 529 aa, Jatropha curcas
MCQSQTQYRTTARCQLSVIPQYPAPELLLANRCPKSLEELQEATRKELLTTGNPTASMKLIDSIQRLGIGYHFEEEISMLLERILEWNINGHDLLTSALRFRLLRHNGLPVYSDVFRKFMNKNGKFKESLSKDTMGLLSLHEASYLGSKDEAELVHAMEFTRNYLQGYIAQNKKIGQALELPRHLRMTRLEARNYIDEYSLQTNHSQTLFQLAKLDYNAVQSLHQKELVEIVRWWKELGLVEKLGFARDRPLECYLWTVGIFPQPYDSNSRIQLTKTVAILLVIDDIFDTYGSFSDLILFTDAVRRWDLSAIESLPEYMKICYMALYNTTNDIAYMVLKQNGWSIVPHLKRTWIDMFEAFLTEAKWFKNGYVPTLEEYLVNGVTTGGTYMALVHSFFLLGQGVTKETITMLEPYPDLFTSAGKILRLWDDLGTSREEQERGDVASSIECFMKEKAISCEGEGRKEVRQLIRNLWVELNGELIAPSRMPLSTINASFNLARTAQIVYQHGDDMKGLSVDDQVQALLYQPI

SEQ ID NO: 224 - protein, 558 aa, Erythranthe guttata
MGSNYRARNLCICMSLLSPLTITGNYDNALLKYIRQPMVLIPTQEDEGTKRREYLLERTARELQESTTVEKLKLIDTIQRLGIGYYFEEDINAILLVEFSNALITEDNLFTTALRFRLLRHNGFQITSDVFLKFMDENRKFEESLADDTLGLLSLYEASYMGANGEEILEEATKFTKAYLQLSIRQLSPPHHHDQLVIEALKLPRHMRMARLETRQYIEKYGAQSDCDAALLELATLDYNKVQTQHQIELAEITRWWRQLGLVKKLTFARDRPLECFLWTVGLLPEPKYSTCRIELAKTIAILLVIDDIFDTYGKMDELVIFTDAIRRWDLEAIETLPKYMKICYLALYNTTNEICYNVLKENGWTVLPYLKSTWIDMIEGFMVEATWFNGGSEPNLEEYIENGVSTAGAYMAFVHLFFLIGEGVTRENSELLLNKPYPNIFSFAGRILRLWDDLGTSKEEEERGDMASSIRLFMREKNIEREEEGRKRVLEEIYGLWKDLNGEMMCENRVMPLAIIDVALNMARASQVVYNHEEDSYFSNVDNYVEALFFTPIASYL

SEQ ID NO: 225 - protein, 515 aa, Vigna radiata
MTMTSFEQLKIKSQEVLLDSSDSLRTLKLIDTIQRLGIDHHFEEEINLQLGRLGDCNNAQDLFATALQFRLLRHNGCSTSSDVFNKFLDKSGNFKESATRDVWGMLSLHEASYLGAKGEEVLQHAMECSRAHLHQSLPHLSPEVGRVVVEALKYPRHQRMARLEAKNYMVQYSKESNQIPALLELARLDYDMVQSMHQKELAEISRWWKDLGLIERLGFGRDGPRECFLWSLGVFPEPRHSNCRIELAKAICILQVIDDMFDTYGTLDELILFTEAVQRWDLDAMEKLPEYMKICYMALYNTTHDIAYRIQRDHGQTVVASLKRTWIDLLEAYLKEAKWFNNKYVPTFKEYLDNGVISSGSCLALVHATVLIGENLSRETISLMSPYPRLFTCSGEILRLWDDLGTSKEEQERGDNACSIQCIMKENDILDESFARKRIRQLLGNLWPELNGLAMANTTLPSAVTKASFNMARTSQFIYQHGDDQQMPTVDDLVQALLFTSSEKYREETDINFVV

SEQ ID NO: 226 - protein, 519 aa, Vigna radiata
MSVAFRDKVPIQIDPGKKKLEQVKRSSQETLLNSSDPTKTLKIIDIIQRLGIGHHFEEEINVNLGKVRDFDFSQDLCSTALQFRLLRHNGCHASSDVFKKFLDHSGNFKESITSDIWGMLSMYEASYLGAKGEEVLQQAMDFSSAHLQQSLPLLSPDVGNHVVRALTLPRHLRMSRLEARNYIEEYSHVSSKMPCLLEMAKIDNAMVQSMHQKELADISRWWKDLGLVESLGFARDKPGECFLWTVGVFPEPCYSNCRVELAKTICILLVMDDIFDTYGTLDELVLFTEAIKRWDLDAMEQLPEYMKISYLALYNTTQEIACRIQMEHGQTVLSCLKRTWMDIFEAFLKEAKWFSNKYVPTFQEYLANGVISSGSYMALVHATFLIGDGISKETISMMNPYPRLFSCSGEILRLWDDLGTSREEQERGDNACSLQCLMTENNISDENVARKEIRGFIRNLWPELNSLALTTTSLPFSVIKASLNMARTSQVIYQNGDDQNTFTVDDYVQTLLFTPAQNS

SEQ ID NO: 227 - protein, 517 aa, Arachis duranensis
MLREKVECLESNDRKKSLEQVKKEGQEALLKKSSDPVGTMKIIDSIQELGIGHHFEEEINALLGKICHWDASQDLFATSLQFRLLRHNGWTTFPENFNKFLDKSGNFKESLSRDIGGVLSLYEASFLGAEGEGVLQQAMDFSRGHLHQSIPHMAPELGRQVSRALRLPRHLQMERLEAKNYMDQYSRTTTKIPALLELAKLDYDMLQSLYKRELGEITRWWKELGLIESLGFARDRPSECFLWTVGIFPEPRYSNCRIELTKTVCILLVMDDIFDTYGSFDDLVLFVKAIKRWDLDAMEQLPEYMKICYMALYNTTHEIAYKIQKERGLTAVAYLKKTWIDIFEAFLEEAKWFNQGYVPSFREYLDNGVISAGSYMAMTHATFLVGDGISKDTLSLMKTYPRLFSCSGEILRFWDDLGTSTEEQERGDNACSIQCYMRENNGCDENEARKHIRGLIGKLWLELNGVAMNTTALPSSIVKACFNMARTAQVIYQHGDDKSTYTVDDYVQTLFFTPSAI

SEQ ID NO: 228 - protein, 529 aa, Vigna angularis
MAMKQNKLSIKSVAFRDKVPIQIDPGKKKLEQVKRSSQETLLNSSDPTKTLKIIDNIQRLGIGHHFEEEINVKLGKVADCDFSQDLCSTALQFRLLRHNGCHASSDVFKKFLDHSGNFKESITTDIWGMLSMYEASYLGAKGEEVLQQAMDFSSAHLQQSLPLLSPDVGNHVVRALTLPRHLRMSRLEARNYIEEYSQVSSKMPYLLEMAKIDNAMVQSMHQKELADISRWWKDLGLVERLGFARDKPAECFLWTVGVFPEPCYSNCRIELAKTICILLVMDDIFDTYGTSDELVLFTEAIKRWDLDAMEQLPEYMKISYLALYNTIQEIACRIQMEHGQTVLSCLKRTWIDIFEAFLKEAKWFSNKYVPTFEEYLANGVISSGSYMALVHATFLIGDGISKETISLMNPYPRLFSCSGEILRLWDDLGTSREEQERGDNACSLQCLMTENNISDEIVARKQIRGFIRNLWPELNSLALTTASLPFSVIKASLNMARTSQVIYQNGDDQNTFTVDDYVQTLLFTPALEY

SEQ ID NO: 229 - protein, 426 aa, Vigna angularis
MTQTIPTMTSLEQLKIKSQEVLLDSSDSLRTLKLIDTIQRLGIDHHFEEEINLQLGRVADCNNAQDLFATALQFRLLRHNGWSTSSDVFNKFLDKSGNFKESVTGDVWGMLSLHEASYLGAEGEEVLQHAMECSRAHLHQSLPHLSPEVGRVVVEALKLPRHQRMVRLEAKNYMVQYSKESSQIPALLELARLDYDMVQSMHQKELAEISRWWKDLGLIERLGFGRDGPRECFLWALGVFPEPRHSNCRIELAKAICILQVIDDMFDTYGTLDELILFTEAVQRWDLDAMEKLPEYMKICYMALYNTTHEIAYRIQRDHGQTVVASLKRTWIDLLEAYLKEAKWFNDKYVPAFEEYLDNGVISSGSCLALVHATVLIGENLSRETISLMSPYPRLFTCSGEILRLWDDLGTSKEEQERGDNACSIQ

SEQ ID NO: 230 - protein, 505 aa, Lupinus angustifolius
MCSTKSLEQVKRKIQETLLNSDRLGTLKIIDSIQHLGIGHHFEEEINALLGRVLDYDTAHDLFATSLHFRLLRHNGFPTSSDIFKKFCDKSGYFKESLSKDIWGMLSLYEASYLGAEGEELLHKAMDFSKVHLHNSISQLGPQVSMHIARSLILPRHLKMAKLEAKNYIHEYSHASNQIPALLELAKLDYDMAQSLHQRELAEICRWWKELGLVGRLGFGRDRPAECFLWTLGIFPEPSYSNCRIELTKTICILLVMDDIFDTYGSLDDLILFTDAIRRWDPDAMVQLPEYMKICYMALYNTTHEIAFRIQKEHGVTVVAHLKRTWIDIFEAFLEEAKWFNKGYMPTFREYLNNGVISAGSYMAMVHATFLIGDGNSKENISMMKPYPRLFSCSGEILRLWDDLGTSTEEQERGDNACSIQCHMRENNISDENEARKHIREFIGKLWQELNGIAMNTNLPWSIVKASLNMARTAQVIYQHGDDKSTYSVDEYVQTLLFTPSPRNS

SEQ ID NO: 231 - protein, 495 aa, Cajanus cajan
MSSQEALLNTSDSLRTLKTIDTIQRLGIEHHFKEEINLQLGRLTNWEPVENLFATALQFRLLRHNGWPTRSDVFNKFLDKSGNFKESVTKDIWGMLSLYESSYLGTKDEEVLQQAMDFSRAHLHRSLPYLSLEVKNIVGGALMLPRHLRMARLEAKNYMVECRKTSSQIPDLLKLARLDFDISQSMHQKELAEISRWWKNLGLVESIGFGRDKPGECFLWVLGILPEPCYSNCRIELAKAISVLQVMDDMFDTHGKLDELVPFTMAIRRWDLDAMEQLPEYMKICYMALYNTIHEIAYRIQKEHGKTVITCIKRTWIDIFEAYLKEAKWFNNKYVPTFREYLDNGVISSASFMALVHSTLLIGDNLSEKTISMMIPYPRIFSCSGEILRLWDDLGTSRDEQKRGDNACSIQCLMAENNISDENVARKHIRKLIGNLWLELNGLALTTTDFPLSVARTSLNMARAAQAIYQHGDDQSSLTVDDQVQALLFTPSANY

SEQ ID NO: 232 - protein, 543 aa, Cajanus cajan
MSSMFQPRNLSLKTSRPPMIYNNLSIKSIAFRDKVLLFQTDPSTRNLEQVKRRSQELLLNSRDPIKTLKIIDNIQRLGIGHHFEEEINVQLGRVGDWDVTQDLLATALQFRLLRHNGWPARSDAFKKFLDNTGNFQESITNDIRAMLSLYEASYLGAKGEEILQQAMDFSTAHLHQSLPHLSPELGRIVARSLTLPRHLRMARLEAKNYMEEYSQASSQIPSLLELAKLDHVMVQMMHQKELAEISGWWKKLGLVERLGFARDRPEECFLWTVGVFPEPYYSTCRIELTKTICILLVMDDIFDTYGTLDELILFTKAIKRWDLDAMEQLPEYMKICYIALYNTTHEIANKIEKAHGESVVACLKRTWTDIFEAFLKEAKWFNNKYIPTFREYLDNGVISSGSYMAMVHATFLVGDGLSKETISMMKPYPRLFSCSGEILRLWDDLGTSREEQERGDNACSIQCFMTENNISDENVARKHIRELIRNLWPELNGLAMTTSALPLSVMKASLNMARTAQVIYQHGDEQNAFTVDDYVKTLLFTQH

SEQ ID NO: 233 - protein, 503 aa, Manihot esculenta
MANPTASLKLIDSIQRLGLGYHFEEEISMLLERFVDWNPDDQDLLATALRFRLLRHNGFPASSDVFSEFKGRDGKFKQSLSKDPLGLLSLYEASYLGTKEEEELVQAMEFTRTHLQKRSFSLLPSQHRRQVVQALEVPRHLRMSRLEARNYIDEYSRESNHSPDLLDLAKLDFNAVQQLHQKELVEIIRWWKQLGLVEKLGFARDRPLECYLWTVGIFPEPYNSNCRIELTKTIAILLVIDDIFDTYGSLPDLVLFTEATRRWDLSAMESLPEYMKICYMALYNTTNDIAYMVLKQHGWSIVPHLKRTWIDMFEAFLAEAKWFNKEYVPSLEEYLVNGVTTGGTYMALVHSFFLMGQGVNKQTLALMEPYPDLFTFSGKILRLWDDLGTAREEQERGDVASSIECFMRESRISGEDEARKQIRELIRSLWIELNGELVAPSSMPLCIVNASFNLARTAQVVYQHGDDKKGSSVDDQVQALIYKPIPLDDEAKVVHDLETMVVI

SEQ ID NO: 234 - protein, 504 aa, Hevea brasiliensis
MERTRKELLTPANPSASLKFIDSIQRLGIGYHFEEEINMLLERCVDWNAGQDLLATALRFRLLRHNGFPACSDVFNKFKDKDGKFNQSLSKDPLGLLSLYEASYLGTEEEVELVQAMEFTRTHLQKISIPLFSPQDRCQVFQALEIPRHLRMSRLETRNYINEYSMESNRKPTLLDLAKLDFNAVQLVHQKELVEIIRWWKQLGLVEKLGFARDRPLECYLWTLGIFPEPYNSNCRIELTKTIAILLVIDDIFDTYGLLPDLVLFTEAIRRWDLSAMEPLPEYMKICYMALYNTTNDIAYMVLKQHGWSIVPHLKRTWIDMFEAFLAEAKWFNNEYVPSLEEYLVNGVTTGGTYMALVHAFFLMGQGVTKQTVAMMEPYPDLFSFAGKILRLWDDLGTAREEQERGDVASSIQCFMREKGISCEDEGRKQVRQLIRSLWIDLNGELVAPSSMPLSIINASFNLARTAQVVYQHGDDKKGSSVDDQVQALIYKPISLGDMKQDCV

SEQ ID NO: 235 - protein, 533 aa, Helianthus annuus
MATIAISTTQGNDFLLVKPQLVISSEGDVRKRIHNLKENTRRALMTASNPAMKLKLVDMIQRLGLGYIFEEDIKIMLETLAHGQPDDDLYTVALRFRILRHNGLHPNPDVFGAFMDANGKFGESLVEDTEGLLSLYEASYLGANGEDILSQAKEFTTTHLKKSVSRFTHKLGEQILESFEIPRHLRMVRLEARRYIEEYGKDIDHTPVFLQLAKLEYNQVQSLHQMELAELSRWWRDLGLASKLTFARDRPIECFLWSVGLLPEPKYSTVRIELAKTVSILLVIDDVFDTYGTYDDLVLFTKAIQRWDVDEIEQLPEYMKICYMALHNTTNEICDVVHKNHGLSVLPYLRKAWIDTIQAFMVEAEWVKRGYEPDLKDYIDNGITTAGTYMALVHLFFLMGEGVTPKNMSSLLHSYPPFFTHAGKILRLWDDLGTSKEEQERGDIASSVQLLMKEKNIKSEEDGRKQILELIQTSWKELNEALVAPNIFPFSIVNVALNMSRASQVVYQHDDGNSYFSSVDDHARSLFFTPIDM

SEQ ID NO: 236 - protein, 526 aa, Olea europaea
MAENGAMYNYIRQPVIVTPEVDDGTKHSELVERTRRELQRSTKPVETLKLIDNLQRLGIAYYFEDDINAILDQFSDGLPDEDLFTTALCFRLLRDSGYKTGSDVFLKFMEKNMKFKDHLAQDTIGLLSLYEASSMGANGEEILSEAKEFTEIHLRQSMPRLVPQLRRQVSSALELPRHLRMARLEARRYIEEYGNESDHDPAVLELARLDYNKVQLQHQMELAEITRWWKQLGLVEKLSFARDRPLECFLWTVGLLPEPKYSSCRIELAKTIAILLVIDDIFDTYGKMEELVLFTEAIQRWDLDELETLPPYMRICYMALYNTTNEICYKILKEYGFCVLPYLKSTWIDMIEGFMVEANWFNGGHGPNLEEYIENGVSTAGAYMALVHLFFLIGEGVTNENIAKLLRKPYPKLFSAAGRILRLWDDLGTAKEEEERGDLASCMQILMREKNIDCENEGRNYILKAINGLWKDLNDELISPNAMPLAITKVALNMARASEVVYKHEEDSYFSSVDNYVQALFFTPIN

SEQ ID NO: 237 - protein, 508 aa, Lactuca sativa
MSEVHGSNRVTELKEKIRALMTDSNPIILMELVDKIQRLGLGCTFEEDINKIMKYLVQGHPNDDLYTVSLRFRLLRHNGLHVNPDVFGSFMDANGKFKESLSEDIEALLSLYEASYMGADGEDILSEAREFTTRHLKKSVFKLTPLLRNKVLQSLKLPRHLRMERLEARMYIEEYGNEQDHIPILLELAKLEYNEIQILHQMEISEITRWWKHLGLTDKLPFARDRPLECFLWTVGLLPERKYSTKRIEVAKTISILLVIDDIFDTYGSYDDLVLFTKAIQRWDMQEIEQLPEYMKICYMALCNTTNEICYEILKEHGLNVLPFLRKTWIEMVEAFMVEAEWVKRGTEPNLKDYIENGVKTAGTYMALVHLFFLIGEGVTPENMRTLTDSYPSFFSISGTILRLWDDLGTSKEEQERGDVASSIQLLMKEKNITCEEEGRKYILQFIDSSWKELNKTLVVPNTLPISIIRIALNMARASQVVYQHEESSYFSRVDNHVKSLFFAPIQI

SEQ ID NO: 238 - protein, 517 aa, Citrus clementina
MQNVLTYEGDRGTKSLEEELQERTRKALRKSSNDPTATMKLIDTIQRLGIGYHFEDEIMERLERFSDGDAAGEENLFENALRFRLLRHNGLPACTDIFKKFINKEGKLKESVSKDTRGMLSLYEASYLATQDKDILFEAMEFTKTELTQSVSLMDSQSSRHVVQALALPRHLRMSRSEAGNYINEYSQSWNHDQTLLQLAKSDFNMVQSLHQRELAEIKRWWKQLGLVDKLGFGRDRPLECFLWTVGIFPEPYYSNCRIELAKTIALLLVIDDIFDTYGSLSDLVLFTEAIQRWDLGAMEHIPEYMKICYMALYNTTNEISYRILKDHGWNVVPQLKRTWIDIFEAQLSEAKWFSEGYVPTQEQYLRNGVTTGGTYMALVHAFCLMGQDVTKETLAMMEPYPNLFSCSGKILRLWDDLGTAREEQERGDVASSIECYMREKTISCEEEARKHIRQLIRSLWVELNGMLVAPAALPASIVNASLNLARTAQVVYQHGDDNTVTSVNGHIERLFCNPLT

SEQ ID NO: 239 - protein, 565 aa, Medicago truncatula
MVVTELRVSCLTSALSCCNSRSSTYHSRILLLQKSKPGFMHRKLSINSTALNDKVAPLQTDDSTKSLEQVKRKSQEALLNSSDPMVALKMIDSIQGLGIGHHLEDEINIQLGRICDWDLSLDLFGTSLQFRLLRHNGWPTCSDVFKKYLDKSGNFKESLTKDIWGMLSLYEASHLGTEDEEILKRAMKFSSAHLNELIPHLSPEIGRNIAKSLTLPKHLRMARLEARNYMEEYSKGSNQIPALLELAKLDSDMVQSLHQRELTEICRWSKELGLIERLSFARDRPTECFLWTVGIFPEPCYSNCRIELTKTICILDVIDDIFDNYGTLEDLVLFTKAIKRWDLDGMEQLPEYMKICYMALYNTTNEIAYRIQKEHGLTVVSCLKKTWMDMFDAYLEEAKWFNSGYVPSFKTYLDNGVISVGSCMALVHSTFLIGDGLSKETISMMKQYPRLFSCSGEILRLWDDLGTSTEEQERGDNACSIQCLMKENNISDENEARKHLRLLIGNLWRELNGLAMSKTIPLSVVKASLNMARTAQVIYQHGDDQSTFTVDDYVQTLIFTSFPNS

SEQ ID NO: 240 - protein, 580 aa, Cicer arietinum
MAVINELRISYLTNSIARSYSRISIYQSQILSLQKSKSEIMHSKFTIKSVALNHKVVPLQSDDRSKSLEQVIRRSREVLLNSSDPILTLKMIDSIQGLGISHHFEDEINIQLGRICNWDTSQDIFATSLQFRLLRHNGYPTTSDVFRKFLDKSGNFKESFTKDIWGMLSLYEASHLGTEDEEVLKKAMEFSKTHLNELIPNLAPEVGSHIARALTIPKHLRMVRLEARNYMEEYRQATDQISVFLELAKLDSQIIQSLHQRELAEISRWWKELGVVDRIGFGRDRPTECFLWTVGIFPEPYYTNCRIELTKTICILLVMDDIFDTYGTFHELVLFTNAIKRWDLDAMEQLPEYMKICYMALYNTTNEIAYRIQKEHGLNVVSHLKRTWIDIFDAFLEEAKWFNSGYVPSFKTYLDNGVISAGSCMALVHATFLIGNHVHGLSKETFSTTKPYPRLFSCSGEILRLWDDLGTSTEEQERGDNASSIQCLMRENNISDENEGRKHIRLLIGKLWRELNGLVMTKTIPFSIVKASLNMARTSQLIYQHGDDKTTFTVDDYVQTLIFTSRGGHGSDRVGFGSKT

SEQ ID NO: 241 - protein, 647 aa, Citrus sinensis
MASALVDDDEDGNQHHQDPKRQYEQCLKKCERREGGVVAVQAAARNRSRKSNEEEKKRECLTPQATGRDQKKSNKGAILTTFTNKDSGPLVSLRTRSWQQGRSLHSNSLSCICQLSSLPKPLVTDFKTSPRQNVLTYEGDRGTKSLEEELQERTRKALRKSSNDPTATMKLIDTIQRLGIGYHFEDEIMERLERFSDGDAAGEENLFENALRFRLLRHNGLPACTDIFKKFINKEGKLKESVSKDTRGMLSLYEASYLATQDKDILFEAMEFTKTELTQSVSLMDSQSSRHVVQALALPRHLRMSRSEAGNYINEYSQSWNHDQTLLQLAKSDFNMVQSLHQRELAEIKRWWKQLGLVDKLGFGRDRPLECFLWTVGIFPEPYYSNCRIELAKTIALLLVIDDIFDTYGSLSDLVLFTEAIQRWDLGAMEHIPEYMKICYMALYNTTNEISYRILKDHGWNVVPQLKRTWIDIFEAQLSEAKWFSEGYVPTQEQYLRNGVTTGGTYMALVHAFCLMGQDVTKETLAMMEPYPNLFSCSGKILRLWDDLGTAREEQERGDVASSIECYMREKTISCEEEARKHIRQLIRSLWVELNGMLVAPAALPASIVNASLNLARTAQVVYQHGDDNTVTSVNGHIERLFCNPLT

SEQ ID NO: 242 - protein, 514 aa, Vigna angularis
MSFVPIQIDPGKKKLEQVKRSSQETLLNSSDPTKTLKIIDNIQRLGIGHHFEEEINVKLGKVADCDFSQDLCSTALQFRLLRHNGCHASSDVFKKFLDHSGNFKESITTDIWGMLSMYEASYLGAKGEEVLQQAMDFSSAHLQQSLPLLSPDVGNHVVRALTLPRHLRMSRLEARNYIEEYSQVSSKMPYLLEMAKIDNAMVQSMHQKELADISRWWKDLGLVERLGFARDKPAECFLWTVGVFPEPCYSNCRIELAKTICILLVMDDIFDTYGTSDELVLFTEAIKRWDLDAMEQLPEYMKISYLALYNTIQEIACRIQMEHGQTVLSCLKRTWIDIFEAFLKEAKWFSNKYVPTFEEYLANGVISSGSYMALVHATFLIGDGISKETISLMNPYPRLFSCSGEILRLWDDLGTSREEQERGDNACSLQCLMTENNISDEIVARKQIRGFIRNLWPELNSLALTTASLPFSVIKASLNMARTSQVIYQNGDDQNTFTVDDYVQTLLFTPALEY

SEQ ID NO: 243 - protein, 619 aa, Helianthus annuus
MPYLMFHTTYYINHIQLKRNKGMASQAYITSIFSHKVLYQRQLIIIPPFKGSKNCRSIFSSAQACPNTITSATEELIDTLSPLSMTDTVSYSGDRNSLILDHYGMMVIPPHDVNNRIEELKEYTRRALMNTSDSTMTLKLIDTIQRLGVGYYYEEEEIRKILKKLTHVLPKDDLYTVALHFRLQRHYGLHTNPAAEVFRNFMDENGELKKSSSEDIEGVLSLYEASCLGSSGEDFLLHHKEITRRYLSRSVSKLSLKLHKNVVEGLKLPRHMRMERLEARRYIEEYGNEDDHNPFVLEFAKYDYNKVQSVFQRELVEVNRWWEHLGLSSKLGFVRDRHVECFLWTVGLLPEPSFSGSRIELAKTIAIMLVIDDIYDTYGSYDDLVLFTEAIKRWDLNAIEQLPEYMKICYQALYNTNNEICDKIKKERCLSVQPFLRKTWIDMAEAYMVEAEWVKRGRIPTLNDYIENGVTTSGTYMALVHLFFLISYGLTTENMKHLLDPYPKFFTMAGTILRLWDDLGTIKEEQERGDMLSSIHLLMKEENITCEEEGREGILQMIYALWNDLNVELLTPDAVLFRMIKVALNMSRTSQVVYQHNDDSYLLSVKDHVQSLFYEPVDI

SEQ ID NO: 244 - protein, 618 aa, Helianthus annuus
MPYLMFHTTYYINHIQLKRNKGMASQAYITSIFSHKVLYQRQLIIIPPFKGSKNCRSIFSSAQACPNTITSATEELIDTLSPLSMTDTVSYSGDRNSLILDHYGMMVIPPHDVNNRIEELKEYTRRALMNTSDSTMTLKLIDTIQRLGVGYYYEEEEIRKILKKLTHVLPKDDLYTVALHFRLQRHYGLHTNPAEVFRNFMDENGELKKSSSEDIEGVLSLYEASCLGSSGEDFLLHHKEITRRYLSRSVSKLSLKLHKNVVEGLKLPRHMRMERLEARRYIEEYGNEDDHNPFVLEFAKYDYNKVQSVFQRELVEVNRWWEHLGLSSKLGFVRDRHVECFLWTVGLLPEPSFSGSRIELAKTIAIMLVIDDIYDTYGSYDDLVLFTEAIKRWDLNAIEQLPEYMKICYQALYNTNNEICDKIKKERCLSVQPFLRKTWIDMAEAYMVEAEWVKRGRIPTLNDYIENGVTTSGTYMALVHLFFLISYGLTTENMKHLLDPYPKFFTMAGTILRLWDDLGTIKEEQERGDMLSSIHLLMKEENITCEEEGREGILQMIYALWNDLNVELLTPDAVLFRMIKVALNMSRTSQVVYQHNDDSYLLSVKDHVQSLFYEPVDI

SEQ ID NO: 245 - protein, 549 aa, Helianthus annuus
MPYLMFHTTYYINHIQLKRNKGMASQAYITSIFSHKVLYQRQLIIIPPFKGSKNCRSIFSSAQACPNTITSATEELIDTLSPLSMTDTVSYSGDRNSLILDHYGMMVIPPHDVNNRIEELKEYTRRALMNTSDSTMTLKLIDTIQRLGVGYYYEEEEIRKILKKLTHVLPKDDLYTVALHFRLQRHYGLHTNPAGLKLPRHMRMERLEARRYIEEYGNEDDHNPFVLEFAKYDYNKVQSVFQRELVEVNRWWEHLGLSSKLGFVRDRHVECFLWTVGLLPEPSFSGSRIELAKTIAIMLVIDDIYDTYGSYDDLVLFTEAIKRWDLNAIEQLPEYMKICYQALYNTNNEICDKIKKERCLSVQPFLRKTWIDMAEAYMVEAEWVKRGRIPTLNDYIENGVTTSGTYMALVHLFFLISYGLTTENMKHLLDPYPKFFTMAGTILRLWDDLGTIKEEQERGDMLSSIHLLMKEENITCEEEGREGILQMIYALWNDLNVELLTPDAVLFRMIKVALNMSRTSQVVYQHNDDSYLLSVKDHVQSLFYEPVDI

SEQ ID NO: 246 - protein, 508 aa, Olea europaea
MENINCSERIEELRENTRKALRRALDPMAAMELIDTLQWLGIAYNYEEEIDSWLNKLINWDAGDDLHATGLRFRLLRTEGLPVSCDVFEKFMEKNGKFKESISQDTRGLLSLYEASSLGASGEDILSEAMRFAVTHLRLSIPSMGKQLCRQVTRALELPRHLRMARLESRLYIDEYSMGSNFSQILLEQAKLDYNKVQSLHQIELAELSRWWKQLGLVEKLKFGRDRPMECYFWTVGILPDPKYSQARIELAKTIAILLVIDDIFDTYGSINELLLFNDAIQKWNLDAIEQLPAYMKICYMALYNNTNEIAYSILKEQGRNVLPSLKQVWMNTIEAFMIEANWFNSGHVPNLANYLKNAVTTSGSYMALVHIFFLLGEGISHGNVKSMEKPYPKIFSCSGQILRLWDDLGTSKEEQDRGDNASSIPLFMKEKNLPSEDEARECIMQLIGNLWKELNTELLSSSLPLPIIRACFNMSRTSEVIYQHEEDSYSSGVDNFVKFLLLEPIGL

SEQ ID NO: 247 - protein, 605 aa, Olea europaea
MLPQSHIALDRHKLRESEKIDESAHKPLEQQGRENVIGNDRMAIERIDIAVVSAIRSTNKDFNIERTAKLGVKVFTGTVDPAVAQAWMTKIERVLHTMENINSSERIEELRENTRKVLRRALDPMAAMELIDTLQWIGIAYNYEEEIDSWLNKLISWDAGDDLHATALRFRLLRSEGLPVSCDVFKKFMEKNGKFKESISQDTRGLLSLYEASSLGASGEDILSEAMRFAVTQLRLSMPSMGKQLCRQVTRALELPRHLRMARLESRLYIDEYSMGSNFNQILLEQAKLDYNKVQSLHQIELAELSRWWKQLGLVEKLKFGRDRPMECYFWTVGILPDPKYSQPRIELAKTIAILLVIDDIFDTYGSINELLLFNDAIQKWNLDAIEQLPAYMKICYMALYNTSNEIAYNILKEQGRNVLPSLKRVWMNTIEAFMIEANWFSSGHVPDLANYLKNAVTTSGSYMALVHIFFLLGEGISHGNVKSMEKPYPKIFSCSGQILRLWDDLGTSKEEQDRGDNASSIPLFMKEKNLPSEGEARECIMQLIGNLWKELNTELLSSSLPLPIIRACFNMSRTSQVIYQHEEDSYSSGVDNFVKFLLLEPIGL

SEQ ID NO: 248 - protein, 508 aa, Olea europaea
MDKTICSKGIEELQERTRNALQRALDPMAAMELIDTLQWLGIAYNYEEEIDSWLNKLINWDAGDDLHATALRFRLLRTDGFPVSSDVFKKFMEKNGKFKESISQDTRGLLSLYEASSLGASGEDILSEAMRFAVTHLRLSMPSMGKRLCRQVTRALELPRHLRMARLESRLYIDEYSMGSNFNQILLEQAKLDYNKVQSLHQIELAELSRWWKQLGLVEKLKFGRDRPMECYFWTIGILPDPKYSQPRIELAKTIAILLVIDDIFDTYGSINELLLFNDAIQKWNLDAIEQLPAYMKICYMALYNTTNEIAYNILKEQGRNVLPSLKRVWMNTIEAFMIEANWFNSGHVPDLANYLKNAVTTSGSYMALVHIFFLLGEGISHGNVKSMEKPYPKIFSCSGQILRLWDDLGTSKEEQDRGDNASSIPLFMKEKNLPSEGEARECIMQLIGNLWKELNTELLSSSWPLPIIRACFNMSRTSQVIYQHEEDSYSSGVDNFVKFLLLEPIGL

SEQ ID NO: 249 - protein, 514 aa, Olea europaea
MKVLHTMENINCSKRIEELQENTRKALQRALDPMAAMELIDTLQWLGIAYNYEEEIDSWLNKLINWDAGDDLHATGLRFRLLRTEGLPVSCDVFKKFMEKNGKFKESISQDTRGLLSLYEASSLGASGEDILSEAMRFAVTQLRLSMPSMGKQLCRQVTRALELPRHLRMARLESRLYIDEYSMGSNFNQILLEQAKLDYNKVQSLHQIELAELSRWWKQLGLVEKLKFGRDRPMECYFWTVGILPDPKYSQPRIELAKTIAILLVIDDIFDTYGSINELVLFNDAIQKWNLDAIEPLPAYMKICYMALYNTTNEIAYNILKEQGRNVLPSLKRVWMNTIEAFMIEANWFNSGHVPNLANYLKNAVTTSGSYMALVHIFFLLGEGISHGNVKSMEKPYPKIFSCSGQILRLWDDLGTSKEEQDRGDNASSIPLFMKEKNLASEGEARECIMQLIGNLWKELNTELLSSSLPLPIIRACFNMSRTSEVIYQHEEDSYSSGVDNFVKFLLLEPIGL

SEQ ID NO: 250 - protein, 493 aa, Catharanthus roseus
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 251 - protein, 493 aa, Catharanthus roseus; identical to SEQ ID NO: 250

SEQ ID NO: 252 - protein, 493 aa, Catharanthus roseus; identical to SEQ ID NO: 250

SEQ ID NO: 253 - protein, 493 aa, Catharanthus roseus; identical to SEQ ID NO: 250

SEQ ID NO: 254 - protein, 493 aa, Catharanthus roseus; identical to SEQ ID NO: 250

SEQ ID NO: 255 - protein, 518 aa, Catharanthus roseus
MSATKSIVGEALEYVNIGLSHFLALPLAQRISLIIIIPFIYNIVWQLLYSLRKDRPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 256 - protein, 496 aa, Catharanthus roseus
MELLKLLCLILFLTLSYVAFAIIVPPLNFPKNIPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 257 - protein, 535 aa, Catharanthus roseus
MSSVAENIIQHATHNSTLHQLAKDQPSVGVTTAFSILDTLKSMSYLKIFATLICILLVWDQVAYQIKKGSIAPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 258 - protein, 538 aa, Catharanthus roseus
MQYKLALNGKTLKGETTTEAVDAATAEKVFKQYANDNGVDGEWTYDDATKTFTVTEGGGSLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 259 - protein, 480 aa, Catharanthus roseus
MALYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 260 - protein, 486 aa, Catharanthus roseus
MALLLAVFLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 261 - protein, 523 aa, Catharanthus roseus
MQYKLALNGKTLKGETTTEAVDAATAEKVFKQYANDNGVDGEWTYDDATKTFTVTEGGGSPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 262 - protein, 465 aa, Catharanthus roseus
MAPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 263 - protein, 471 aa, Catharanthus roseus
MALLLAVFPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 264 - protein, 492 aa, Nepeta cataria
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIAL

SEQ ID NO: 265 - protein, 490 aa, Nepeta mussinii
MDFLTITVGLVSAIIITFIYGFSLSRRGKNLPPGPTPLPLIGSLHLLGGQPHKSLARLANIYGPLMRLRLGSVNTIVVSSAAVAREVLQKHDLAFSSRSIPDALHAHDHFKYSVVWLPVASRWRSLRKTMNSNIFSGSRLDANQHLRSRKVEELVDYCRECSRTAEAVHVGRAAFRTVLNSLSNTIFSKDLADPFSDSGKEFKEIVSNIMKEAGMPNLVDFFPFLARFDPQGIRRRTTVYFGKIIHLFSGLIQEKLENTNQEENIDVIQILLNTSRQSPQEIDRTHIERMCLDLFVAGTDTSSSTVEWAMAEALKNLETMKTAKVELEQVIGKGKTIQETDVSRLPYLQCMVKETLRLHPPVPFLIPRTVDQDVEVLGHVVPKNSRVFVNMWAIGRDPDVWENPLEFNPRRFLDSEVDVRGTNFELIPFGAGRRICPGLPLAMRMVPVMLGSLLNSFDWKLEGGENLDMDEKFGITLEKAQPLRVVPISL

SEQ ID NO: 266 - protein, 492 aa, Nepeta cataria; identical to SEQ ID NO: 264

SEQ ID NO: 267 - protein, 490 aa, Nepeta mussinii; identical to SEQ ID NO: 265

SEQ ID NO: 268 - protein, 492 aa, Nepeta cataria; identical to SEQ ID NO: 264

SEQ ID NO: 269 - protein, 490 aa, Nepeta mussinii; identical to SEQ ID NO: 265

SEQ ID NO: 270 - protein, 492 aa, Nepeta cataria; identical to SEQ ID NO: 264

SEQ ID NO: 271 - protein, 490 aa, Nepeta mussinii; identical to SEQ ID NO: 265

SEQ ID NO: 272 - protein, 501 aa, Vigna angularis
METNSTLFFTFTVLLITIITFLKALKSLFTPNKSKSNLPPGPKGLPLVGNLLQLGAKPHQTLATLANIHGSIMSLKLGQETTIVMSSAEAAKGVLQIHDHFLSNRKIPDAMRGSSHDHFSLPFMPVSQQWRELRKLCNELLFSNKNLDATQGLRSKKVRELYSDIHRSSLKGEPVNIGRLAFKTTINQLSNTIYSEDFLQSAEKAGEMKELVTNIMKEVGRPNLADCFPVLKMIDPHGIRRRTGSYFSKLLNIFKSLIHKRLELRKDAAGYCTKKDMLDAMLNDAQHKMDIVKIQRLSLDLFVAGTDTVTSTVEWAMAELLHNPHVMSKAKEELERIIGKDNLVEESDIAKLPYLQAIVKETFRLHPAVPLLLPRKAEVEFEMHGYTIPKGAQVLINVWAIGRDPNLWEKPRLFWPERFLESEIDFKGRSFELTPFGGGRRICPGLPLAIRLVFLMLGLFINSFDWELQDIQPEDMNMDENFGLTLEKAQPVLAIPIIPKH

SEQ ID NO: 273 - protein, 1048 aa, Bacillus megaterium
MTIKEMPQPKTFGELKNLPLLNTDKPVQALMKIADELGEIFKFEAPGRVTRYLSSQRLIKEACDESRFDKNRLWPTVPLFSLYAKEDTVWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 274 - protein, 1048 aa, Bacillus megaterium; identical to SEQ ID NO: 273

SEQ ID NO: 275 - protein, 498 aa, Camptotheca acuminata
MDFFSFLLYFLFTLSLVQATISLVRGSKHKGRKLPPGPAPLPIVGNLLKLGDQPHKSLADLAKIHGPIMTLKLGHITTVIISSSDLAKEVLQKQDLAFSSRSIPDAIRAHNQFQYSVVWLPVANQWRSLRKILNSNIFSGNRLDANQHLRWRKVQELIAYVRKSSQVGDAVDIGRAAFRTSLNLLSNTIFSVDLADPNNDSAKEFKDLVSNIMVEAGKPNLVDYFPVLEKIDPQGIRRRMTIHFGKVLEMFGRLINERLEFRRLRSSVISNDVLDVLLNTEESGNEIDRNHIERMCLDLFVAGTDTTSSTLEWAMAEVLHNPETLVKAKAELEQIIGRGKAIEESDISNLPYLRSIIKETLRLHPPVPFLIPRKVEVDSEVSGYTVPKGSQVLVNAWAIGRDPCCWENPLNFSPERFLNSELDVRGRDFELIPFGAGRRICPGLPLAIRMVPVMLGSLLNSFDWKLDGGIKPEELDMEEKFGITLQKAQPLRAVPTLV

SEQ ID NO: 276 - protein, 493 aa, Vinca minor
MDYLTIALGLLFALTFYQGLTYLSRRSQKLPPGPLPLPIIGNLHLLGDHPHKSLAKLSKKYGPIMSLKLGRITTLVISSSTTAKEVLQKQDLAFSSRSVPNALHAHNQFQYSVVWLPVASRWRSLRKILNSNIFSGNRLDANQHLRCRKVEELIAYCRKNCQSGEAVDLGRAAFRTSLNLLSNTIFSKDLTDPYSDSAKEFKDLVWNIMVEAGKPNLVDFFPVLEKVDPQGIRRRMTVHFGKVIQLFNGLINERLDKRKSRGGYNDVLDVLLTTTEENPEEIDRTHIERMCLDLFVAGTDTTSSTLEWAMAEMLRNPEKMKKTQEELAEVVGRGKLIEEGDVSRLPYLRCVVKETLRVHPPVPFLIPRKVVQDVEVCGYKVPKGSQVLVNAWAIGRDETFWKDALGFKPERFLESELDTRGRDFELIPFGAGRRICPGLPLANRMVPVMLGSLLNSFNWKLEGGIAPKDLDMEEKFGITLQKAHPLRAVPSPL

SEQ ID NO: 277 - protein, 493 aa, Ophiorrhiza pumila
MDYLTIALGLLFALTLIQGWSFLSRRSKKLPPGPTPLPIIGNLHLLGDQPHKSLAKLAKTHGPLMSLKLGQITTLAISSSGMAKEVLQKQDLAFSSRSIPDAIHAHNQFQYSVVWLPVATRWRSLRKILNSNIFSGNRLDANQHLRCRKVQELIAYCRKNCQTGEAVDIGRAAFRTSLNLLSNTIFSKDLTDPYSDSAKEFKDLVWNIMVEAGKPNLVDFFPVLEKFDPQGIRRRMTIHFGKVLEMFGGLINERLDNGKSRGGNNDVLDVLLNASEETPDEIDRTHIERLCLDLFVAGTDTTSNTLEWAMAEMLKTPEKMKKAKAELAEVIGKGKAIEEADVSRLPYLRCIVKETLRLHPPVPFLIPRKVEQDVEVCGYNVPKGTQVLVNAWAIGRDETTWENALEFKPERFLESELDIRGRDFELIPFGAGRRICPGLPLAVRMVPVMLGSLLNSFDWKLGGSIAPKDLDMEEKFGITLQKANPLLAVPISL

SEQ ID NO: 278 - protein, 493 aa, Rauvolfia serpentina
MDYLTITLGLLFALTFYQGLSYLSRRSKKLPPGPAPLPIIGNLHMLGDQPHKSLAKLSKKHGPIMSLKLGQITTVVVSSSGMAKEVLQKHDLAFSSRSIPNALHAHNQYQFSVVWLPVASRWRSLRKTLNSNIFSGNRLDANQHLRSRKVEELIAYCRKNCQTGEAVDVGRAAFRTSLNLLSNLIFSKDLTDPYSDSAKEFKDLVWNIMVEAGKPNLVDYFPVLEKVDPQGIRRRMTVHFGKVLKLFDGLVNERLEQRRSRGGKNDVLDVLLTNSEENPEEIDRTHIERMCLDLFVAGTDTTSSTLEWAMAEMLKNPDKMKKTQAELAEVIGRGKAIEESDLPRLPYLRCVVKETLRIHPPVPFLIPRRVEQDVEVCGYKVPKGSQVLVNAWTIGRDEAVWEDALAFKPERFLESELDIRGRDFELIPFGAGRRICPGLPLALRTVPLMVGSLLNSFNWKLEGGITPKDLDMEEKFGITLQKAHPLRAVPIPF

SEQ ID NO: 279 - protein, 498 aa, Lonicera japonica
MDFFTIALSLLFAFTLFKAIISLTKSGKNKNLPPGPAPLPIIGSLHKLGDQPHQSLAKLAKIYGPIMSLKLGRITTVVISSSDAAKEVLQKKDLAFSSRHVPDALHAHNQFKFSVVWLPVAPQWRSLRKILNSNIFSGNRLDANQHLRCRKVEELITYCRKSSHSGDAVDIGRAAFRTSLNLLSNTIFSKDLTDPYQDSAKEFKELVGNIMVEAGKPNLVDFFPSLKKIDPQGIRHRMTIHFGKVLELFGGLINERLELKSSQKSDEKNDVLDVCLSISKENPDEIDRTHIERMCLDLFVAGTDTTSSTLEWAMAEVLRNPETLVKAKAELEEVIGKGKILAEADVSNLPYLRCIVKETLRIHPPVPFLIPRKVEMDVEACGYTVPKNSQVFVNVWAIGRDPTLWEDPLSFKPERFMASELDVRGRDFELLPFGAGRRICPGLPLAIRMVPVMLGSLVNSFNWKLDGGIAPKELDMGEKFGITLAKAQSLRAVPSPLV

SEQ ID NO: 280 - protein, 491 aa, Erythranthe guttata
MDFITLALVLIFVLIIIHAIQTISTRGKKLPPGPTLLPLIGNLHLLGDQPHKSLCRLAETHGPLMRVRLGFINTVVISSAEMAKEVLQKHDLAFSSRSVPNALLAHDQFKYSAVWLPVGPRWRSLRKALNSNMLSVGRLDFGQNLRCRKVDELVEYCRRSSISGEAVDVGRAAFRTSLNLLSNTIFSKDLTDPFSDSAKELKDLVWNIMLEAGKPNLVDFFPILGKLDPQGIRRRMTVNFGKVIDLLSGLIDERIERGKSDQNADVIDVLLAACKENPEDIDRTHIERICLDLFAAGTDTSSSTVEWAMAEALANSEIMKKAKAELEEVVGKGKVIEEADISRLPYLQCMVKETLRLHPPVPLLIPRRVEDDVDVCGYTVPKNSQVLVNAWAIGRDAGIWENPLEFKPERFVGSEVDVKGRDFELIPFGGGRRICPGLPLAVKMVPVMVGSLLNSFDWKIEYSGIGEFDMEEKFGITLQKARPLLAVPIPL

SEQ ID NO: 281 - protein, 494 aa, Picrorhiza kurrooa
MDFLTIILGLLFAITLIHGYQLLSSKGKRLPPGPTPLPLIGSLHLLGDQPHQSLAKLAKKHGELMCLRLGFINTIVISSAAMAKEVLQKQDLAFSSRMSPNAVHAHDQFKYSVVWLPVAARWRSLRKVLNSKIFSGNRMDANQHLRGRKRQELIAYCRKRSQTGGAGDMGRAPFRNPVNLAVEHDFFKRIEDPYSDSAKEFKDLVWNIMLEAGKPNLVDFYPVLEKVDPQGIRKRMTVHFGKVIELFSGLINERTEKGKTQDAGTTDVIDVLLKISKENPDEIDRTHIERLCLDLFVAGTDTTSNTLEWAMAESLKNPEIMKKAKAELEQVIGKGKVLDEADIQRLPYLRCMVKETLRIHPPVPFLIPRKVEQDVEVCGYTVPKNSQVFVNAWAIGRDAETWPNPLEFKPERFMESEVDMRGRDFELIPFGAGRRICPGLPLALRMVPVMLGSLLNSFDWKLEGGAGPKELDMEEKFGITLQKALPLMAVPVPL

SEQ ID NO: 282 - protein, 494 aa, Olea europaea
MDFLTIVLGLLFALTLIQAFRSISTRGKNLPPGPTPLPIIGNLHLLGDQPHKSLAKLAKTYGPIMCLRFGSINTVVITSSAMAKEVLQKQDLAFSSRHIPNAIHAHNQFKYSVVWLPVASTWRSLRKILNSNMFSGNRLDANQHLRVRKVQELITYCRKNSQAGEAVDIGRAAFRTSLNLLSNTIFSKDLTDPFSDSAKEFKDLVWNVMVEAGKPNLVDFFPVLEKLDPLGIRRRMTIHFGKIIELFGGLINERLKRRMSDNSKNSDVLDVLLDTSQENPEEIDRVHIERLCLDLFVAGTDTTSSTLEWAMAETLKNPATMKKAKAELEEVIGKGKVLEEADVSRLPYLRCMVKEALRIHPPVPFLIPRRVEQDVEVSGYTVPKNSQVLVNAWAIGRDPTLWENPLEFKPERFMESELDIRGRDFELIPFGAGRRICPGLPLAIRMVPVMLGSLVNSFDWKLEGGISPKDLDMEEKFGITLQKANPLRAVPTPL

SEQ ID NO: 283 - protein, 493 aa, Gentiana rigescens
MDYLTIALGFLFALTLYQALISFSRKSKNLPPGPAPLPFIGNLHLLGDQPHKSLAKLAKKHGPIMGLQFGQVTTIVVTSSGMAKEVLQKQDLAFSSRSVPNALHAHDQYKYSVIWLPVASQWRSLRKVLNSNIFSGNRLDANQHLRCRKVQELIAYCRKNCQTGEAVDLGRAAFRTSLNLLSNTIFSKDLTDPYSDSAKEFKDLVWNVMVEAGKPNLVDFFPVLDKVDPQGIRKRMTFHFGKILQLFGGLINERLQQNKAKGAHKDVLDVLLKTSQETPDELNRTHIERMCLDLFVAGTDTTSSTLEWAMAEMLKSPDKMNKAKEELAQVIGKGKAVEEADIASLPYLRCAIKETLRIHPPVPFLIPRRTEQEVEVCGYTVPKNSQVFVNVWAIGRDETTWPDALEFKPERFLESEIDMRGRDFELLPFGAGRRICPGFPLAVRMVPVMLGSLLNSFDWKLEGGIAPKDLDMEEKFGITLQKAHPLRAIPTSL

SEQ ID NO: 284 - protein, 492 aa, Nepeta cataria; identical to SEQ ID NO: 264

SEQ ID NO: 285 - protein, 688 aa, Arabidopsis thaliana
MTSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 286 - protein, 714 aa, Catharanthus roseus
MDSSSEKLSPFELMSAILKGAKLDGSNSSDSGVAVSPAVMAMLLENKELVMILTTSVAVLIGCVVVLIWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 287 - protein, 714 aa, Catharanthus roseus; identical to SEQ ID NO: 286

SEQ ID NO: 288 - protein, 688 aa, Arabidopsis thaliana; identical to SEQ ID NO: 285

SEQ ID NO: 289 - protein, 714 aa, Catharanthus roseus; identical to SEQ ID NO: 286

SEQ ID NO: 290 - protein, 688 aa, Arabidopsis thaliana; identical to SEQ ID NO: 285

SEQ ID NO: 291 - protein, 714 aa, Catharanthus roseus; identical to SEQ ID NO: 286

SEQ ID NO: 292 - protein, 712 aa, Nepeta mussinii
MDSTTEKLSPFDLMAAILKGVKLDNSNGSAETSQPAVVAMLMENKDLMMMLTTAVAVLLGCVVYLVWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 293 - protein, 692 aa, Camptotheca acuminata
MSSDSELIRWFESIFGVSLGSNSVSDSVAMFVTTSVAVIIGLLFFLWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 294 - protein, 712 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDITLANGNGYTVFDAQHPYKANVAVKRELHTPESDRSCIHLEFDIAGSGLTMKLGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSEKLFLGRPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 295 - protein, 688 aa, Arabidopsis thaliana; identical to SEQ ID NO: 285

SEQ ID NO: 296 - protein, 712 aa, Nepeta mussinii; identical to SEQ ID NO: 292

SEQ ID NO: 297 - protein, 692 aa, Camptotheca acuminata; identical to SEQ ID NO: 293

SEQ ID NO: 298 - protein, 712 aa, Nepeta mussinii; identical to SEQ ID NO: 292

SEQ ID NO: 299 - protein, 692 aa, Camptotheca acuminata; identical to SEQ ID NO: 293

SEQ ID NO: 300 - protein, 495 aa, Swertia mussotii
MDFDFLTIAIGFLFTITLYQALNFFSRKSKNLPPGPSPLPLIGNLHLLGDQPHKSLAKLAKKHGPIMGLQLGQVTTIVVTSSGMAKEVLQKQDLAFSSRSIPNAIHAHDQYKYSVIWLPVASRWRGLRKALNSNMFSGNRLDANQHLRSRKVQELIAYCRKSSQTGDAIDVGRAAFRTSLNLLSNTMFSKDLTDPYSDSAKEFKDLVWNVMVEAGKPNLVDYFPLLDKVDPQGIRKRMTIHFGKILELFGGLIDERLQQKKAKGVNDDVLDVLLTTSEESPEEIDRTHIQRMCLDLFVAGTDTTSSTLEWAMSEMLKNPEKMKAAQAELAQVIGKGKAVEEADLARLPYLRCAIKETLRIHPPVPLLIPRRTEQEVEVCGYTVPKNSQVLVNVWAISRDDAIWKDPLSFKPERFLESELEMRGKDFELIPFGAGRRICPGLPLAVRMVPVMLGSLLNSFDWKLEGGIAPKDLDMEEKFGITLQKAHPLRAVATPL

SEQ ID NO: 301 - protein, 498 aa, Camptotheca acuminata; identical to SEQ ID NO: 275

SEQ ID NO: 302 - protein, 498 aa, Lonicera japonica; identical to SEQ ID NO: 279

SEQ ID NO: 303 - protein, 491 aa, Erythranthe guttata; identical to SEQ ID NO: 280

SEQ ID NO: 304 - protein, 486 aa, Erythranthe guttata
MDFITLFSLGLVFILILMTAVQTISTRGKKLPPGPTPLPLIGNLHLLGDQPHKSLCRLAKTHGPLMYLRLGFINTVVISSAEMAKEVLQKHDLAFSSRSIPNAIHAHDQFKYSVVWLPVGPRWRSLRKALTANMFSSSRLDSGQKLRCRKVQELVDYCRSGEVVDVGRAAFRTSLNLLSSTIFCKDLTDPFSDSAKEFRDLVWNIMVEAGKPNLVDFFPILGKLDPQGVRRRTTVHFGELLYLFGGLIDERLEKGKSDQNADVMDVLLAAWKENPEEIDRTHIERMCLDLFIAGTDTSSSTVEWAMAEALANPEIMKKAKAELEEIVGKGKVLEEADISRLPYLRCMVKETLRLHPPVPFLIPRRVEDDVDVCGYTVPKNSQVLVNAWAIGRDAGIWENPLEFKPERFVGSEVDVKGRDFELIPFGGGRRICPGLPLAVRMVPMMVGSLLNSFDWKVEEEIIDMEEKFGITLQKARPLLAIPIPLF

SEQ ID NO: 305 - protein, 492 aa, Nepeta cataria; identical to SEQ ID NO: 264

SEQ ID NO: 306 - protein, 494 aa, Picrorhiza kurrooa; identical to SEQ ID NO: 281

SEQ ID NO: 307 - protein, 489 aa, Picrorhiza kurrooa
MDFLTIILGLLFAVTLIHGYQLLSSKGKRLPPGPTPLPLIGSLHLLGDQPHQSLAKLAKKHGELMCLRLGFINTIVISSAAMAKEVLQKQDLAFSSRMSPNAVHAHDQFKYSVVWLPVAARWRSLRKVLNSNIFSGNRLDANQHLRCRKVQELIAYCRKSSQTGAAVDMGRAAFRTSLNLLSNTIFSKDLTDPFSDSAKEFKELVWNIMLEAGKPNLVDFYPALEKLDPQGIRKRMTVHFGKVIELFSGLINERTETGKTQMLGTTDVIDVLSDSKETRRIDRTHIERLCLDLFVGGLTHINTLVWAMADHVRTRKYCKSRLTRTVIGKGKFSTKQNIQRLPYLRCMVKETLRIHPPVPFLIPRKVEQDVDVCGYTVPKNSQVFVNAWAIGRDPETWPNPLEFKPERFMESEVDMRGRDFELIPFGAGRRICPGVTLAVRMVPVMLGSLLNSFDWKLEGGAGPKDLDMEEKFGITLQKALPLMAVPIPL

SEQ ID NO: 308 - protein, 490 aa, Nepeta mussinii; identical to SEQ ID NO: 265

SEQ ID NO: 309 - protein, 494 aa, Olea europaea; identical to SEQ ID NO: 282

SEQ ID NO: 310 - protein, 494 aa, Sesamum indicum
MDFLTIVLGLLFTLVLVHGLQTLSARAKKLPPGPTPLPLIGSLHLLGDQPHQSLAKLAKTHGPLMCLRLGFINTVVVSSAAMAKEVLQKQDLVFSSRTIPDAIHAHDQFKYSVVWLPVASRWRSLRKVLNSNIFSGSRLDANQHLRCRKVQELIAYCRKNSQTGEPVDVGRAAFRTSLNLLSNTIFSKDLTDPFSDSAKEFKDLVWNIMVEAGKPNLVDFFPMLEKLDPQGIRRRMTIHFGKVIDLFSGLINERLEKGKTQNAGNSDVIDILLATSKENPEEIDRVHIERMCLDLFVAGTDTTSSTLEWAMAEALKNPETVKKAKAELEEVIGKGKVLDEADISRLPYLRCMVKETLRIHPPVPFLIPRRVDQDVEVCGYTVPKNSQVFVNAWAIGRDPDVWKDPLEFKPERFLESELDMRGRDFELIPFGAGRRICPGLPLAVRMVPVMLGSLLNSFDWKLENGIGPKELDMDEKFGITLQKARPLRAVPLPL

SEQ ID NO: 311 - protein, 493 aa, Coffea canephora
MDSLMVVLASLLSLTLIKGLSSLARRAKKHPPGPTPLPLIGNLHLLGDLPHQSLAKLAKIHGPVTSLKLGQLTTVVISSSSMAREVLQKKDLAFSSRSIPDAVHAQNHSHYSVVWLPVASRWRSLRRIMNSNMFSANSLDANQHLRCRKVQELVDCCQKNCQTGEAVDIGRAGFMTSLNLLSNTIFSKDLADPYSDTAKEFKDLVWDIMVEAGKPNPVDFFPLLKKFDPRGVRRRMSVHFEKVLKLFEGLINERLESGNSGDEGRDVLDELLTTSEESSQEFDRIDMVHMFLDLFVAGTDTTSSTLEWAMTELLKNPEKMRKAQAEIAGGIGKGKAIEEADVARLPYLQCIVKETLRIHPPVPFLIPRRVEQDVELCGYNVPKGSQVLVNAWAICRDEIVWENALVFKPERFLESEIDIRGRDFELIPFGAGRRICPGLPLAARVVPVMLGSLLNSFDWKLEGGNTPKDLDMEEKYGITLQKALPLRAVPLPL

SEQ ID NO: 312 - protein, 495 aa, Dorcoceras hygrometricum
MDWITIVVVLLSALTLSHGYRVLYSTWVKKHPPGPTPLPIIGNIHLLGNQPHKSLAKLAKTHGPLMRLRLGFINTVVISSSAMAKEVLQKQDLAFSSRWAPDALHACDHSNYSVVWLPVAARWRSLRKVLTSNIFSGSRLDANQHLSSRKVQELIAYCGSSSQTGEAVDVGRAAFRTSLNLLSNTIFSVDLADPFSDSGKEFKDLVCNIMVEAGKPNLVDYFPFLEKIDPQGIRRRMTFHFEKVIELFSCLIAERLEKGESKDSETNDVIDVLLATSKENPEEMDRTHIERLCLDMFVAGTDTTSNTLEWAMTEAIRNPEIMKKAKSELEEIVGKGKIISEEEVQRLPYLRCMVKETLRIHPPVPFLIPRKVEEDVQVCGYTVPRNSQILVNAWAIGRDGDAWKNPLEFKPERFLGSEIDVRGRDFELIPFGAGRRICPGLPLAIRMVPVILGSLLNSFDWKLEGGSSPDEVDVEEKFGITLQKAIPLRAVPIPL

SEQ ID NO: 313 - protein, 493 aa, Gentiana rigescens; identical to SEQ ID NO: 283

SEQ ID NO: 314 - protein, 493 aa, Vinca minor; identical to SEQ ID NO: 276

SEQ ID NO: 315 - protein, 493 aa, Ophiorrhiza pumila; identical to SEQ ID NO: 277

SEQ ID NO: 316 - protein, 493 aa, Rauvolfia serpentina; identical to SEQ ID NO: 278

SEQ ID NO: 317 - protein, 493 aa, Cinchona calisaya
MDYLTIVLGLLFALTLYQGLSSLSRKAKKLPPGPTPLPIIGNLHLLGDQPHKSLAKLAKKHGPLMSLKLGQITTVVVTSSDMAKEVLQKQDLAFSFRSIPDALHAHDQYRYSVVWLPVASRWRSLRKILNSNIFSGNRLDANQHLRLKKVQELVAYCRKNSQVGEAVDVGRAAFRTSLNLLSNTLFSKDLTDPYSDSAKEFKDLVWNIMLEAGKPNLVDFFPVLEKIDPQGIRRRMTIHFGKVLKLFGGLVDERLEQGKSKGGNSDVLDVLLTTSEEAPGEIDRTHIERMCLDLFVAGTDTTSNTLEWAMAEVLRNPEKMKKAKAELAEVIGKGKLVEEADVSRLPYLRCIVKETLRIHPPVPFLIPRRVDQDVEVCGYNVPKGSQVLVNAWAIGRDETVWENALAFKPERFWESELDIRGRDFELIPFGAGRRICPGLPLAVRMVPVMLGSLLNSFDWKLEAGIAPKGLDMEEKFGITLQKAYPLRAVPISL

SEQ ID NO: 318 - protein, 493 aa, Tabernaemontana elegans
MDYLTLVLGLLFALTFYQGLSYLSRKSKKLPPGPAPLPFIGNLHLLGDQPHKSLAKLSKKHGPLMSLKLGHITTVVISSSGMAKEVLQKQDLAFSSRSVPDALHAHNQFQFSVVWLPVASRWRSLRKILNSNIFSGNRLDANQHLRCRKVQELIAYCRKNCQTGEAVDVGRAAFRTSLNLLSNTIFSKDLTDPYSDSAKEFKDLVWNIMVEAGKPNLVDFFPVLEKVDPQGIRKRMTVHFGKVLKLFNGLINERLEQKRLQSGNNDVLDVLLTTSEESPEEIDRTHIERMCLDLFVAGTDTTSSTLEWAMAEMLKNPDKMQKTQAEIAEVIGKGKAIEEADVARLPYLRCVVKETLRIHPPVPFLIPRKVDQDVEVCGYKVPKGSQVLVNAWAIGRDGTVWEDPLAFKPERFFESEIDIRGRDFEVIPFGAGRRICPGLPLAARMVPVMLGSLLNSFNWKLEGGIAPKDLDMDEKFGITLQKAHPLRAVPSPL

SEQ ID NO: 319 - protein, 493 aa, Catharanthus roseus; identical to SEQ ID NO: 250

SEQ ID NO: 320 - protein, 493 aa, Catharanthus roseus; identical to SEQ ID NO: 250

SEQ ID NO: 321 - protein, 493 aa, Catharanthus roseus; identical to SEQ ID NO: 250

SEQ ID NO: 322 - protein, 493 aa, Catharanthus roseus; identical to SEQ ID NO: 250

SEQ ID NO: 323 - protein, 134 aa, Catharanthus roseus
MASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPEFVIKILQFLVPLLILGLAFAVRHYTKEK

SEQ ID NO: 324 - protein, 110 aa, Yarrowia lipolytica
MIINGKVYDISSFVDEHPGGEEVLLDAGGTEATNAFDDVGHSEDAYGILNDLYVGEVDPSEDVIRKTHTVKTSYEDGESVGDDHGSSSMIFLIVAAAVAAAAFFYLQGQK

SEQ ID NO: 325 - protein, 138 aa, Nepeta cataria
MPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQYWFASITVAGLSVVVGYLCIRKKQTT

SEQ ID NO: 326 - protein, 134 aa, Catharanthus roseus; identical to SEQ ID NO: 323

SEQ ID NO: 327 - protein, 138 aa, Nepeta cataria; identical to SEQ ID NO: 325

SEQ ID NO: 328 - protein, 136 aa, Artemesia annua
MASDPKNFVFDDISKHNKTKDCWLIIDGKVYDVTPFMEDHPGGDEVLLAATGKDATDDFEDVGHSDDAREMMHKYYIGEVDKATVPKKRAYVPPADRHYNPDKTQDFIVKILQFLVPLVILGLAFAVRSYTKERSA

SEQ ID NO: 329 - protein, 134 aa, Arabidopsis thaliana
MSSDRKVLSFEEVSKHNKTKDCWLIISGKVYDVTPFMDDHPGGDEVLLSSTGKDATNDFEDVGHSDTARDMMDKYFIGEIDSSSVPATRTYVAPQQPAYNQDKTPEFIIKILQFLVPILILGLALVVRHYTKKD

SEQ ID NO: 330 - protein, 360 aa, Catharanthus roseus
MAKSPEVEHPVKAFGWAARDTSGHLSPFHFSRRATGEHDVQFKVLYCGICHSDLHMIKNEWGFTKYPIVPGHEIVGIVTEVGSKVEKFKVGDKVGVGCLVGSCRKCDMCTKDLENYCPGQILTYSATYTDGTTTYGGYSDLMVADEHFVIRWPENLPMDIGAPLLCAGITTYSPLRYFGLDKPGTHVGVVGLGGLGHVAVKFAKAFGAKVTVISTSESKKQEALEKLGADSFLVSRDPEQMKAAAASLDGIIDTVSAIHPIMPLLSILKSHGKLILVGAPEKPLELPSFPLIAGRKIIAGSAIGGLKETQEMIDFAAKHNVLPDVELVSMDYVNTAMERLLKADVKYRFVIDVANTLKSA

SEQ ID NO: 331 - protein, 378 aa, Catharanthus roseus
MTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKF

SEQ ID NO: 332 - protein, 376 aa, Nepeta cataria
MADNTNPGVITCKAAVAWKPLEPLKVEEIQIQPPKPTEVRIKMLYASICHTDTVCWTGILYDMFPRVLGHEGVGVIESVGEEVTDLKVGDTVMPLYVGECGKCPNCASGKSNFCSNYPLTLGLMADGTTRMSAKGQQLYQLFSCSTWSEYAVIESNYVVKVDPKLSLSGASLLTCGFTTGYGAVWKVVNFEKGSTVAVVGLGAVGFGAVKAAQILGASKIIGVDINETRRDKAKALGVTDFINPKSSDKTMSQLIQEATGGLGVDCCIECTGVPSLLNEAIASTKVGSGEVVLISAGDEQNTELNYVPLLLGRTVKGTIYGGVRIHSDLHKIVDKCISKEIDLDEIITHEVSLADVNKGFLEYMKQPDCVKVIIKF

SEQ ID NO: 333 - protein, 377 aa, Sesamum indicum
MANTSSTSPVITCKAAVIRKPGEPLQVEEIQVDPPKPTEVRIKMLCASMCHTDILCCNGFPAPLFPRIPGHEGVGVVESVGDEVTHVKVGDTVMPLYLGECGECQNCSSGRTNLCHKYPLDFSGLMADGTSRMSVGGEKIYHVFSCSTWSEYIVLESYYAVKVDPRLSLPHASFLSCGFTTGFGSTWREVNVKKGSTVAVIGLGAVGLGAVKGAQIQGAAKIIGIDINELKQEKAKAFGITEFINPKLSDRSVSELIKEATGGLGVDYCIECTGVPALLNEAIEGSKVGLGTVVLIGAGLEKSVELNYIPLLCGRTVRGSIYGGVRAQSDLPKIVEKCVNKEIDLDHLITHEVSLAEINKAFEYMKHPDCVKVVIKF

SEQ ID NO: 334 - protein, 375 aa, Camptotheca acuminata
MSKTSSQVITCKAAVSWGAGLPLKVEEIQVEPPKSSEVRLKMLCASLCHTDILCCNGLPVPLFPRVPGHEGVGMVESVGEGITGLKEGDIVMPTYIGECGKCENCMSGKSNLCLAYPLPFSGLMPDGTSRMSINGQKLYHFFSCSTWSEYIVIDSNYVVKLDPRISHSHASFISCGFSTGFGATWKEVNVEKGSSVAVFGLGAVGLGVVEGARMQGASKIIGVDINEKKRVKGQVFGLTDFINPSGSDKSISDLIKDLTGGTGVDYCFECTGVATLVNEALEATKVGIGTSVLIGAGLQQSGMINFVPLLCGRTLKGSIYGGVKIQSDLPIIFEKCINKEINLDELLTHEVSLDEINKAFQLLKQPDCVKVLIKI

SEQ ID NO: 335 - protein, 377 aa, Sesamum indicum
MTDGTTTPPVITCKAAVLRKSGEPLQVEEIQVDPPKSTEVRIKMLCASMCHTDILCCNGLPVPLFPRIPGHEGVGVVESVGDQVTHVKVGDTVMPLYLGECGECLNCSSGRTNLCHKYPLGFSGLMADGTSRMSVGGEKIYHHFSCSTWSEYVVIEANYAVKVDPRVSLPHASFLCCGFTTGFGSTWREVNIEKGSTVAVIGLGAVGLGAVKGAQMLGASKVIGIDINELKHEKAKAFGITEFINPKLSDKSVSELIKEATGGLGVDYCFECTGVPALLNEAIEGSKVGLGTIVFIGAGLEKSGELNYIPLLCGRTVRGSIYGGVRTQSDLPKIVEKCVNKEIDLDQLITHEVSLAEINKGFEYMKQPDSLKVVIKF

SEQ ID NO: 336 - protein, 375 aa, Swertia japonica
MTISSPAVVTCKAAVIWKSGEPAKVEEIQVDPPKAGEIRVKMLYASLCHTDVLCCNGLPVPLFPRIPGHEGVGTVESIGENVTNVKEGDIVMPLYLGECGECLNCKSGRSNLCHKYPLGFSGLLLDGTSRMSIKGETVYHHFSCSTWSEYIVIEAAYAFKVDPKMSLPHASFLCCGFTTGFGAAWREVCVEKGSTVAVLGLGAVGLGVVEAARVQGASRIIGLDINDKKREKGEAFGITEFINPTGSEKSVSQLILEATGGLGVDYCYECTGVPALLNESIEASKVGLGTAVLIGAGFETSGVINFIPLLCGRTLKGSIYGGIRPNSDLPAIVDKCISKEINLDELLTHEVSLSEINKAFEYLKDPDCVKVVIKF

SEQ ID NO: 337 - protein, 375 aa, Ophiorrhiza pumila
MTKRSPSVITCKAAVIWKSGEAAKVEEIQVEPPKSSEVRIKMLCASLCHTDILCCNGLPVPLFPRIPGHEGVGMVESVGENVTNLKEGDIVMPLYLGECGECLNCQSGKTNLCHKYPLGFSGLLLDGTSRMSIGGQTVYHHFSCSTWSEYIVIEAPYAVKIDPRLSLPHASFLCCGFTTGFGATWREVNVVKGSTVAVLGLGAVGLGVVEGARMQGASRIIGIDINDMKREKGEAFGMTEFINPKHSEKSISELIKDVTGGLGVDYCYECTGVPALLNEAIDASKVGLGTAVLIGAGLETSGQINYIPLLCGRVLKGSIYGGVRPLSDLPTIIDKCINKEIPLDELMTHEVSLDEINKGFEYLKQPDCVKVVIKF

SEQ ID NO: 338 - protein, 375 aa, Cinchona ledgeriana
MTKSSQGVITCKAAVIWKSGEPPKVEEIQVDPPKASEVRIKMLCASLCHTDILCCNGLPVPLFPRIPGHEGVGMVESVGENVTNLKEGDIVMPLYLGECGECLNCKSGRSNLCHKYPLGFSGLLLDGTSRMSTGGQTIYHHFSCSTWSEYIVIEAAYAAKVDPRISFPHASFLCCGFTTGFGATWREVTVEKGSTVAVLGLGAVGLGAVAGARTQGATRIIGVDINDMKREKGEAFGITEFINPKDSDKSISELIKDATGGLGVDYCYECTGVPALLNEAIDASKVGLGTIVLIGAGLKTSGEINYIPLLCGRTLKGSIYGGVRPQSDLPSIVDKCINKEIQLDELITHEVSLHEINRGFEYLKQPDCVKVVIKF

SEQ ID NO: 339 - protein, 378 aa, Lonicera japonica
MTKSSSEVITCKAAVIWKSGEPAKVEEIKVDPPKSSEVRIKMLCASLCHTDILCCNGLPVPLFPRIPGHEGVGMVESVGEKVTDVKEGDIVMPLYLGECGECLNCKSEKTNLCHKYPLDFSGVLPSDGTSRMSIAKSGEKIFHHFSCSTWSEYVVIESSYVVKVDPRLPLAHASFLACGFTTGFGAAWREANVHKGSTVAVLGLGAVGLGVVSGAKVQGASKIIAVDINDMKREKGESFGMTDFLNPKESGKSASELIKEATGGLGVDYCFECTGVPAMLNEAIDASKVGLGTIVLIGAGMETSGVINYIPLLCGRTLKGSIYGGVRIQSDLPVIIEKCINKEIQLDELQTHEVSLEEINEAFGLLKHPDCVKVVIKF

SEQ ID NO: 340 - protein, 375 aa, Coffea canephora
MTKSTPSVVTCKAAVVWKSGEPPKIEEIQVDPPKASEVRVKMLLASLCHTDILCCHGLPVPLFPRIPGHEGVGMVESVGENVTNLKEGDIVMPLYLAECGECLNCISGKTNLCHKYPLGFSGLLLDGTSRMSIRGQAIYHHFSCSTWSEYIVIEAPYAVKVDPRVSLPHASFLCCGFTTGFGAAWREITVEKGSTVAVLGLGAVGLGVAGGARMQGASRIIGVDRNEMKREKGEAFGMTEFINPKGSDKSISDLIKEVTGGLGVDYCFECTGVPDLLNEAIEASKIGLGTSVLIGAGFETSGDFKYIPLICGRTLKGSIYGGVRPKSDLPLLLEKCANKEIPLDELITHEVTLDEINRGFEYLKHPDCVKVVVKF

SEQ ID NO: 341 - protein, 375 aa, Rauvolfia serpentina
MTKSTPTVITCKAAVLWKAGEPPKIAEIQVDPPKAPEVRVKMLCASLCHTDFLCCNGLPVPLFPRIPGHEGVGMIESVGENVRDLKEGDIVMPLYLGECGECLNCKSGRSNLCHKYPLGFSGLLLDGTSRMSIGGQKVYHHFSCSTWSEYIVTEAAYAVKVDPRVSLPHASFLCCGFTTGFGATWREINVEKGSTVAVLGLGAVGLGAVQGARSQGASRIIGVDINDKKRKKGEAFGITEFINPKGSNKSVSQLIKDATGGLGVDYVYECTGVPALLNEAIEASKVGLGTSVLIGAGLETSGEIKFIPLLCGRTVKGSIYGGVRPKSDLPTIIDKCINKEIPMDELLTHEVSLSEINKAFEYLKQPDCVKVVIKF

SEQ ID NO: 342 - protein, 376 aa, Gentiana rigescens
MTKTITPAVITCKAAVIWKSGEPAKVEEIQVEPPKTGEVRVQMLYASLCHTDVLCCNGLPVPLFPRIPGHEGVGVVESVGENVTNLKEGDIVMPLYLGECGECLNCKSGKSNLCHKYPLGFSGLLLDGTSRMSIKGQTVYHHFSCSTWSEYIVIEAAYAFKVDPKISLPHASFLCCGFTTGFGAAWREVVIEKGSTVAVLGLGAVGLGVVEAARIQGASRIIGLDINDKKREKGEAFGLTEFINPSGSDKSVSQLINGVTGGLGVDYCYECTGVPALLNEAIESSKVGLGTVVLIGAGFETSGTINFIPLLCGRTVKGSIYGGVRPNSDLPAIIAKCVNKEINLDELLTHEVALSDINKGFEYLHDPDCVKVVIKF

SEQ ID NO: 343 - protein, 378 aa, Catharanthus roseus; identical to SEQ ID NO: 331

SEQ ID NO: 344 - protein, 376 aa, Nepeta cataria; identical to SEQ ID NO: 332

SEQ ID NO: 345 - protein, 376 aa, Ocimum basilicum
MANNTNAGVITCKAAAAWKPSEPLVVEEICVEPPKSTEVRIKMLAASMCHTDILLWKGFFPLYPRIPGHEGAGVIESVGEKVANLKVGDTVMPLSIGQCGECSNCATGKTNICFKYPFGISGLMPDGTSRMSAKGQKLYHMFTCSTWSEYTVVDSNFVVKVDPRIPLPHASLLTCGFLTGYGAPWRESRVEKGSTVAVIGLGAVGLGAVSASRILGASKIIGIDVNELKREKATVFGVTEFINPKHSDKTVSQLIQEATGGLGVDCCIECTGVSSLLNEAIASTKVGIGEVVLIGAGEKEKVEISYIPLMLGRSVKGTTLGGVRIHSDLPKIVEKCINKEIDLDELITHEVSLVDVNKGFMEYMNQPDCVKVSVKF

SEQ ID NO: 346 - protein, 377 aa, Sesamum indicum; identical to SEQ ID NO: 333

SEQ ID NO: 347 - protein, 377 aa, Capsicum annuum
MESSNPKVITCKAAVAWKEGESLKMEEIQVDPPKSSEIRIKMLFASLCHTDILCSNGFPVPLFPRVLGHEGVGMIESVGENVTKLKEGDIVMTLYLGECNECPNCKSGRSNLCHKYPMRLSGLMLDGTSRMSIRGGQILYHGLSCSTWSEYAVINANYAVKVDPQQVPLPHTSLLCCGFTTGYGAAWREVCIEKGSTVAVLGLGAVGLGVVEGARSQGAGKIIGVDINNLRRGKGEAFGTTDFINPKEHEASISDMIKGITGGLGVDYVFECTGIPSMLNEAIEASKMGIGTIVVIGAGNGTSREFNLIPLMCGRTMKGSIYGGMRIHSDLPALLHRCANKEIQLDELITHQVSFTEINQLFELLKDPHCLKIIIKF

SEQ ID NO: 348 - protein, 375 aa, Camptotheca acuminata; identical to SEQ ID NO: 334

SEQ ID NO: 349 - protein, 384 aa, Solanum tuberosum
MSPSKLTMESSNRKVITCKAAVVWKEGEMIKIEDIQVDPPKSNEVRIKMLFASLCHTDILTTNGFPYPLFPRVLGHEGVGMIESVGENVTNLKEGDIVMPLYLGECKECPNCKSGKSNLCHKYHLTFSGLMLDDTSRMSIHGGQVLYHSFSCSTWSEYTVINANYVIKVDPKKIPLQHASLLCCGFTTGYGATWREVHVEKGSTVAVLGLGVVGLGAIEGARSQGASKIIGVDINESKRGKGELFGMTDFINPKESRTSVSEMIKDVTEGLGVDYVFECTGIPSMLNEAIEASKLGIGTIVVIGAGHGLTREFNLVPLLCGRTLKGSIYGGIRLHSDLPAILHRCATKEIQLNDLITHQISLTEINQSFELLKDPHCVKIIIKF

SEQ ID NO: 350 - protein, 377 aa, Sesamum indicum; identical to SEQ ID NO: 335

SEQ ID NO: 351 - protein, 375 aa, Swertia japonica; identical to SEQ ID NO: 336

SEQ ID NO: 352 - protein, 375 aa, Ophiorrhiza pumila; identical to SEQ ID NO: 337

SEQ ID NO: 353 - protein, 375 aa, Cinchona ledgeriana; identical to SEQ ID NO: 338

SEQ ID NO: 354 - protein, 378 aa, Lonicera japonica; identical to SEQ ID NO: 339

SEQ ID NO: 355 - protein, 375 aa, Coffea canephora; identical to SEQ ID NO: 340

SEQ ID NO: 356 - protein, 375 aa, Rauvolfia serpentina; identical to SEQ ID NO: 341

SEQ ID NO: 357 - protein, 376 aa, Gentiana rigescens; identical to SEQ ID NO: 342

SEQ ID NO: 358 - protein, 378 aa, Catharanthus roseus; identical to SEQ ID NO: 331

SEQ ID NO: 359 - protein, 375 aa, Olea europaea
MTNRNPEVIKCKAAVVWKAGEPLKVEEIQVDPPKSSEVRIKMLCASLCHTDFLCCNGHPVPLFPRIPGHEGVGMIESVGGGVTNLKEGDRVMPLYLGECGECLNCKSGKTNLCHKYPFNFTGLMPDGTSRMHIGDQIIYHHFSCGTWSEYVVIDANFAVKVDPRVPLAHASFLCCGFTTGFGSAWRAVTIEKGSTVAVIGVGAVGLGVMEAARMQGASRIIGIDKNNFKKKKGEAFGMTEFINPKESDKPVSELIKDATNGLGVDYFYECTGVPALLNEAIEGSKVGLGTIVLIGSGLDLSGELKYIPLLCGRTLKGSTYGGVRPQSDLPIIVEKCINKEIQLDELETHEVSLEEINKAWEYLKQPNCVKIVINY

SEQ ID NO: 360 - protein, 378 aa, Sesamum indicum
MTNTNTTPAVITCKAAVIRKSWEPLQVEEIQVDPPKSGEVRIKMLCASMCHTDMTCCNSGFPVPFFPRIPGHEGVGVVESVGEQVTNLKVGDIVMTLYLGECGECLNCSSGRTNLCHKYPLGFDGLMPDGTSRLSVGGERTYHLVSCSTWSEYAVIDANYTVKVDPRLSPPHASFLCCGFTTGFGSSWREVNIEKGSTVAVIGLGAVGLGAAKGAQLQGASKIIGIDINELKKEKAKAFGITDFINPKLSDKSVSELIKEATGGLGVDYCFECSGVPALVNEAIEGSKMGLGTIMVLGVGPGKSVEVDYIPLLCGRTLRGSTYGGVRTQSDLPKIIEKCVNKEIDLDQLITHEVSLAEINKGLEYMKQPNCVKVVIKF

SEQ ID NO: 361 - protein, 375 aa, Olea europaea
MTRGNPGVITCKAAVVWKSGDPLKIEEIQVDPPKTSEVRIKMLCASLCHTDFLCRNGLPVPLFPRIPGHEGVGMIESVGEGITNLKEGDVVMPLYLGECGECLNCKSGKTNLCHKYPLNFTGLMPDGTSRMHIGDQIIYHHFSCGTWSEYVVIDANFAVKVDPRVSLAHASFLCCGFTTGFGSAWREVTIEKGSTVAVIGVGAVGLGVIEAARMNGASRIIGIDINNLKKKKGEVFGMTEFINPKESDKPVSELIKETTGGLGVDYCYECTGVAELLNEAIEGSKVGLGTIVFIGAGLHLSGELKYIPLLCGRTIKGSIYGGVRPQTDLPKIVEKCINKEIQLDELLTHEVSLEEINKAWEYLKQPSCVKVVIKY

SEQ ID NO: 362 - protein, 384 aa, Erythranthe guttata
MTSRGVMTCRAAVVRKCREALEVEEIEVDPPKSSEVRIKMLCASICHTDILCWQGVPLVLSTMNTLITSPMFPRIPGHEGVGVIESVGENVTNLKVGDTVMPLYLGECGECSNCISGITNLCHKYPFNFNGLMADGTSRMSVKGERLYHHFSCSTWSEYAVIDANYAVKVDPRISLPHASFLCCGFTTGFGSTSRVVNIHKGSTVAVIGLGAVGLGAVKGAQMLGASKIIGIDINEKKHDKARFFGITEFINPEVSGKSVSELIKEATGELGVDYCFECTGVPALLNEAIEGSKVGTGTVVFIGAGVEKSGELNYIPLLCGRTVKGSIYGGVRTHTDLPSIVDKCVNKEIDLDQLITHEISLAEINKGFQYMKDPNCIKVVIKF

SEQ ID NO: 363 - protein, 360 aa, Catharanthus roseus; identical to SEQ ID NO: 330

SEQ ID NO: 364 - protein, 376 aa, Ocimum basilicum; identical to SEQ ID NO: 345

SEQ ID NO: 365 - protein, 375 aa, Camptotheca acuminata; identical to SEQ ID NO: 334

SEQ ID NO: 366 - protein, 375 aa, Swertia japonica; identical to SEQ ID NO: 336

SEQ ID NO: 367 - protein, 375 aa, Cinchona ledgeriana; identical to SEQ ID NO: 338

SEQ ID NO: 368 - protein, 375 aa, Rauvolfia serpentina; identical to SEQ ID NO: 341

SEQ ID NO: 369 - protein, 388 aa, Arabidopsis thaliana
MSWWWAGAIGAAKKKLDEDEPSQSFESVALIIGVTGIVGNSLAEILPLSDTPGGPWKVYGVARRPRPTWNADHPIDYIQCDVSDAEDTRSKLSPLTDVTHVFYVTWTNRESESENCEANGSMLRNVLQAIIPYAPNLRHVCLQTGTKHYLGPFTNVDGPRHDPPFTEDMPRLQIQNFYYTQEDILFEEIKKIETVTWSIHRPNMIFGFSPYSLMNIVGTLCVYAAICKHEGSPLLFPGSKKAWEGFMTASDADLIAEQQIWAAVDPYAKNEAFNCNNADIFKWKHLWKILAEQFGIEEYGFEEGKNLGLVEMMKGKERVWEEMVKENQLQEKKLEEVGVWWFADVILGVEGMIDSMNKSKEYGFLGFRNSNNSFISWIDKYKAFKIVP

SEQ ID NO: 370 - protein, 389 aa, Digitalis lanata
MSWWWAGAIGAAKKRLEEDDAQPKHSSVALIVGVTGIIGNSLAEILPLADTPGGPWKVYGVARRTRPAWHEDNPINYVQCDISDPDDSQAKLSPLTDVTHVFYVTWANRSTEQENCEANSKMFRNVLDAVIPNCPNLKHISLQTGRKHYMGPFESYGKIESHDPPYTEDLPRLKYMNFYYDLEDIMLEEVEKKEGLTWSVHRPGNIFGFSPYSMMNLVGTLCVYAAICKHEGKVLRFTGCKAAWDGYSDCSDADLIAEHHIWAAVDPYAKNEAFNVSNGDVFKWKHFWKVLAEQFGVGCGEYEEGVDLKLQDLMKGKEPVWEEIVRENGLTPTKLKDVGIWWFGDVILGNECFLDSMNKSKEHGFLGFRNSKNAFISWIDKAKAYKIVP

SEQ ID NO: 371 - protein, 396 aa, Nepeta mussinii
MSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYT

SEQ ID NO: 372 - protein, 397 aa, Nepeta cataria
MSMNWWRDGAAKKRMDESSAVKLQQQQCVALIVGVTGLVGNSLAEMLPLSDTPGGPWKVYGVARRPRPSWNEDHPINYISCDVSNTAEVEAKLPPLSDVTHIFYATWTSRSSEEENCEANGKMLKNVLDTMIPNCPNLKHICLQTGRFHYVASVVDWKINGSHDTPLTEDLPRLNTNNFYYTQEDILLEEVKRKEGLTWSVHRPGTIFGFSPYSMMNLVGTLCVYAAICKQEGAVLRFPGCKGAWDGYSDCADADLIAEHYIWAALDPHAKNQSFNVSNGDVFKWKHLWKVLAEQFGVECGGYEYEEGQQVRLQDVMKDKGPVWDKIVRENGLSNTKLEDVGKWWFSDTILWNECRLDSMNKSKEHGFLGFRNSKNCFLYWIHKLKAYKIVPSSTIS

SEQ ID NO: 373 - protein, 388 aa, Catharanthus roseus
MSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIP

SEQ ID NO: 374 - protein, 388 aa, Catharanthus roseus; identical to SEQ ID NO: 373

SEQ ID NO: 375 - protein, 396 aa, Nepeta mussinii; identical to SEQ ID NO: 371

SEQ ID NO: 376 - protein, 397 aa, Nepeta cataria; identical to SEQ ID NO: 372

SEQ ID NO: 377 - protein, 392 aa, Olea europaea
MSWWFNRSVNGCKQKKIQENGVQQQQNGDIQSFKSVALIVGVTGIVGSSLSEILQYTDTPGGPWKVYGVARRPRPTWLAKSHVEYVQCDVTNTEETISKISPLTDITHIFYVSWMGNEDCSMNAVMFQNILNSVIPNAPNLQHICLQTGSKHYIGLFETDTPESHDTPYSEDLARLKQPNFYHNLEDILFEETAKKGLTWSVHRPALIFGFSPCSLMNIVSTLSVYAAICKHENKPLVYPGSKASWNCFVDAADAELAAEHQIWAAVDPNAKNQAFNCTNGDLFKWKHIWKVLANQFDLEMVGYIEGNEQVSMEELMKDKDSVWDEIVKKNNLMPTKLKEIAAFWFADIAFCLENVLSSTHKNRLHGFMGFRNTYTSFVSCIDKMRAYRFIP

SEQ ID NO: 378 - protein, 367 aa, Catharanthus roseus
MGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIP

SEQ ID NO: 379 - protein, 370 aa, Nepeta mussinii
MQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYT

SEQ ID NO: 380 - protein, 373 aa, Nepeta cataria
MQQCVALIVGVTGLVGNSLAEMLPLSDTPGGPWKVYGVARRPRPSWNEDHPINYISCDVSNTAEVEAKLPPLSDVTHIFYATWTSRSSEEENCEANGKMLKNVLDTMIPNCPNLKHICLQTGRFHYVASVVDWKINGSHDTPLTEDLPRLNTNNFYYTQEDILLEEVKRKEGLTWSVHRPGTIFGFSPYSMMNLVGTLCVYAAICKQEGAVLRFPGCKGAWDGYSDCADADLIAEHYIWAALDPHAKNQSFNVSNGDVFKWKHLWKVLAEQFGVECGGYEYEEGQQVRLQDVMKDKGPVWDKIVRENGLSNTKLEDVGKWWFSDTILWNECRLDSMNKSKEHGFLGFRNSKNCFLYWIHKLKAYKIVPSSTIS

SEQ ID NO: 381 - protein, 331 aa, Nicotiana tabacum
MGLGPYTVYFDALCIGLGAILMQDSRMIAYASYQLNTHEKNYHVHDLELASIVHTLNIWGALIVRRVMGVTKKYSDLKQHYLWRKMEKDIIGHVSQCLNCQQVKYQKLGGLTQRLTKSVHFIPVITSYTSERKPSITWSVHRPDMIFGFSPHSTLNIVGTLCVYTTICKYEGIPLKFPGTKARWDSYSNASDADLVAEHEIWAALCPRAQNKAFNITNGDVFKWKHLWKVLAEQIGVEYVGFDETEKRICLAEMMKDKGHVWDKIVRDNNLVSTTLEEVGLWQFADMILAGGSNRLSSINRSKEHGFMGFRNSTNSFIFWIQKAKDNRLIP

SEQ ID NO: 382 - protein, 400 aa, Elaeis guineensis
MSWWWAGAIGAARKKFDEDSGGGGAAAKFPSVGLVIGVTGIVGNSLAEILPLADTPGGPWKVYGVSRRPHPSSLASQTEGLAIEHVQCDISDREDALAKLSPLTDVTHIFYVAWVNRSTEAENREINSAMLRNVLTAVIPNAPNLQHVCLQTGRKHYLGSFESLGKVKGHEPPFVEDLPRLDCPNFYYDLEDILFEEVAKREGAVTWSIHRPTNIFGFSPSSLMNLMGILCVYAAICRREGVPLRWPGSRVLWEGFSDASDADLIAEHQIWAAVDPYAKNEAFNCSNGDVFKWKHLWPLLAKEFGVEWVGYQGEEARFKLEDAMKGKEGLWEKMVAEHELAPTRLEQVGNWWFADVVLGLEEEYLDSMNKSKEHGFLGFRNTVTSFNSWIDKIKAYKIVP

SEQ ID NO: 383 - protein, 400 aa, Citrus clementina
MSWWWAGAIGAARKKFEEDEPARSYQSVALIVGVTGIVGNSLAEILPLPDTPGGPWKVYGVARRPKPNWNADHLVEYVQCDVSDPEETQAKLSQLTDVTHIFYVTWTNRSTEAENCKINGSMFRNVLRAVIPNAPNLRHVCLQTGTKHYLGPFEAFGKIKPYDPPFTEDMPRLDAPNFYYTLEDILFEEVEKKEELSWSVHRPDTIFGFSPYSLMNLVGALCVYAAVCKHEGIPLRFPGTKAAWECYSIASDADLIAEHQIWAAVDPYAKNEAFNCNNGDVFKWKHLWKVLAEQFGIEDYGLSEEEEEEEEGGGGTQRVKLAEFMKGKEGVWEEIVRENQLQPTRLDEVGAWWFVDLVLTGEAKLASMNKSKEHGFSGFRNSKNSFITWIDKAKGYKIVP

SEQ ID NO: 384 - protein, 391 aa, Sesamum indicum
MSWWWAGAVGAAKQKKLEEDEAPQKHESVALIIGVTGLVGNSLAEILPLSDTPGGPWKVYGVARRPRPSWSDDYPINYIQCDVLNRDDTQAKLSTLTDITHVFYATWTNRPTEAENCEANGRMLQNVLDAVIPNCPNLKHICMQTGRKHYVGPFEAFGKLETQLETPYTEDMPRLNYINFYYTLEDILCKEVEKKEGLTWSVHRPGTIFGFSPHSMMNLVGTLCAYAAICKHEGKVLRFPGCKEAWDGYSDCSDADLIAEHQIWAAVDPHAKNEAFNVNNGDVYKWKHLWKVLAEQFGVECGEHEEGQTITFEGLMKDKGGVWDEMVRENGLTPTKLEDVGLWWFADVILGNKCFLDTMNKSKEHGFLGFRNSKKSFISWIEKVKANKIVP

SEQ ID NO: 385 - protein, 389 aa, Camptotheca acuminata
MSWWWARSLGAQKEFKENGALTSYQSVGLIIGVTGIVGNSLAEILPLPDTPGGPWKVYGVARRPRPAWNTDHPIEYIQCDVASTEDTLAKLSPLTNITHIFYVAWTGSEDCEVNETMFHNVLKAVIPNAPNLRHICIQTGIKHYTGPLDPDGGIQPHDSPFTEDLPRLNAPNFYHNLEDILIEEAAKKKGLTWSVHRPALVFGFSPYSMMNIIGALSVYAVICKHENKPLIYHGAPDNSRDSWNVYADAADADLIAEHQIWAAVDSNAKNEVFNCSNGDVFKWKQMWKILAEQFEVELVGYEDGQKRMSLQERMKGKGPVWDEIVRKHKLLPTKLEDVAQWWFADIVSQSQNLVNGVNKSKENGFLGFRDSKKSFVYWIKKMRAAKIIP

SEQ ID NO: 386 - protein, 391 aa, Cinchona pubescens
MSWWWKRSIDAGKNSGKKLEVNENEAIVEDYKSVALVVGVTGIVGSSLAQVLALPGTPGGPWKVYGVARRSRPVWFSKNHLEYIQCDVSNTQETISKLSPLTDITHIFYVSWIGSEDCDINATMFKNILNTVIPNAPKLQHICLQTGIKHYFGIFEEGSKVEPHDSPFTEDLPRLDVPNFYHDLEDILYEETSKNNLTWSVHRPALVFGFSPCSLMNIASTLCVYATICKYENKPLVYTGSKASWNCYSDAVDADLIAEHQIWAAVDPKAKNQVLNCNNGDVFKWKHVWKTLAEQFGLEMVGYIEGKQQVSLAELMKDKDLVWDEIVKKHNLAPTKLKDIAAFWFADIAFCSENFLSSMNKNKELGFLGFRDSIKSFNSCIDKMRAYRFIP

SEQ ID NO: 387 - protein, 393 aa, Ophiorrhiza pumila
MSWWWKRSIGEGQNSAKTSEEINGLNGEDDQDYKSVGLVVGVTGIVGSSLAQVLTLSDTPNGPWKVYGVARRRRPDWFSKQHLHYIQCDVSNTQETISKLSPLTDITHIFYVSWVGSEDCDTNATMFKNIVNIVIPNAPNLKHISLQTGSKHYFGIFEEGSKVKPNESPFKEDMPRLDVKNFYHDLEDILYEETSKNGLTWSVHRPALVYGFSPCSMMNIVSTLSVYATICKHENRPLTYPGSKASWNCYVDCVDADLIAEHHIWAAVDPKAKNQILNCTNGDVFKWKHIWKALAEEFGLEMVGYIEGKEQVSMAELMKDKDLVWDEIVKKNNLVPTKLNDIAAFWFADIAFSCVDLLSSMTKSKELGFLGFRDTMKSFSSCIDKMRAYRFIP

SEQ ID NO: 388 - protein, 406 aa, Lonicera japonica
MSWWWTRSIGGEKGSSYGKIAEQNGVQANGNSHLHKKEENGGPATYKSVALIVGVTGIVGSSLAEILPLQNTPGGPWKVYGVARRPRPSWTDKSPINYIQCDVSNTIETVAKLSPLTDITHIFYVSWMGSEDCEINAIMFQNILDAVIPNAPNLKHISLQTGIKHYMGVFETDTKQKPHDSPYTEDLPRLNVQNFYHNLEDILYEETAKKGLTWSVHRPALVFGFSPCSMMNIVSTLSVYAAICKHENKPLVYPGSKGSWDCYADAVDADLIAEHHIWAAVDPKAKNEIFNCNNGDVFKWKHIWKALAEKFELEMVGYEEGKEQVSMAEMMKDKEEVWDEIVRENKLVPTKLKDIAAWWFADIAFVTQNVLSSMNKNKEHGFEGFRNSTKSFVSCIDKMKAYRIIP

SEQ ID NO: 389 - protein, 394 aa, Digitalis purpurea
MYTDTTTWWYKRSIGDIEQKNVETNGVALNYKSVALIVGVTGIAGSGLAETLSKSDTPGGPWKVYGVARRPCPEWLAKLHVSYIQCDIGSTDDTSAKLSPLSDITHIFYVSWTGSEDCDKNAIMFKNILDSVIPNAPNLKHISLQTGIKHYWGNMVDEMDTTNVSHDCPFYENMPRLRQPNFYYNLEDLLYEACGTQNGALTWTVHRPALIFGFSPCSLMNIVATLSVYAAICKYENKPLVYTGTETSWNCLVDAVDSDLLADHLVWGAISPNAKNQAFNINNGDVFKWKHIWKVLADQFEIEFVGYEGKEPVSLEGLMKDKDSVWDEIVERYDLVPTKLKDIAAFWFADVAFSIEGAVSSMNKNKEFGFMGFRDSTKSFISSVNKVRTYRFVP

SEQ ID NO: 390 - protein, 389 aa, Antirrhinum majus
MASWWWKGAIGAAMTKSEDNDKAPQNVALIVGVTGIVGNSLAEILPVSDTPGGPWKVYGVARRPRPAWNADHPVQYIQCDVSDPTQTQSKLAPLTDITHIFWVTWANRPTEAECCDINGTMLQNVYDALLPNAPNLTHICIQTGQKHYIGPFETFGKVKPHETPFVEDVPRLDVPNFYYTLEDLTLEACKKKEGLTWSVHRPAAIFGFSPHSMMNMMDSLCVYAAICKHENVPLKFPGTKASWNCYFVCSDADLIAEQQIWSSVDLNGKNEAFNCSNGDLFKWKQMWKVLADSFEVEYEEFDENQEYVSLAERMKDKGPVWDEIVEKNNLLPTKLEEVATFWFADLMFYGECMLDNMNKSKEHGFFGFRNSEKTVLSVIDKMKAHKIVP

SEQ ID NO: 391 - protein, 366 aa, Trifolium subterraneum
MDEGVKGSCEEDEEFKEAPRSSQNIALIIGVTGIVGNSLAEILPLKDTPGGPWKVYGVARRPRPMWNADNPIHYIQCDVSDQNDVELKLTTLTDVTHIFYVSWTSRPTEAQNCEVNGSMLRNVLRSLIPNAPNLCHVSLQTGAKHYVGPFETIGKIKPHESPFMEDVPRLDTLNFYHTLEDILFEEVGTCMMNLIGTLCVYAAICKHEGLPLRFPGSKGAWECYSTASDANLIAEQHIWGAVDSNARNKAFNCSNGDVFKWKHLWKVLADKFGIEDYGFEEGLELKLTEVMKDKRGVWEEIVRENGLQPNKLEDVGDWWFADFTLRVEGVLDSMNKAKEHGFLGFRNSKDSFVSWIDMTKAYKIVP

SEQ ID NO: 392 - protein, 452 aa, Corchorus capsularis
MGANQKKVKLNKDDGSVLAFWTTLGSGQSFWVRKITSFYFRSCFEDFAHLRISSWDFDFGVGCGFRVEWGALEKKFEGDEAPSNFESVGLIVGVTGIVGNSLAEILPLSHDTPGGPWKVYGVARRPRPSWNADHPIEYIQCDISDSKDTEAKLSPLTDITHIFYVSWTNRSSEAENCKINGSMFRNVLRAVIPNAPNLRHICLQTGGKHYVGPFESFCKIQLHEPPFTEDLPRLNTPNFYYTQEDILFEEVQKKEGLTWSVHRPTATFGFSPYSLMNVIGTLCVYAAICKHEGKPLLFPGNKDAWEGFSEASDADLIAEHQIWAAVDPYAKNEAFNVSNGDLFKWKHLWTVLAEQFGIEEYGFEEGKNLGLQEMMKGKERVWEEIVKENQLQETSLADVGVWWFADLVLSVSAAMAMLSMNKSKEHGFLGFRNSKNSFVTWIDKMKAYKIVP

SEQ ID NO: 393 - protein, 331 aa, Nicotiana tabacum; identical to SEQ ID NO: 381

SEQ ID NO: 394 - protein, 409 aa, Panicum hallii
MIRWCWTGEHGAVQERRAADTEAAAPAFANVALVVGSTGTVGAALVDMLQSTDAPAGPWKVYALCRRPLPPWCTSGSAASTSSPNAVVVSLQVDLANAAAVAAALAPLADITHVFYAAWSPQRGSPDAVACETNRAMLRNVLSAVVPSCPALAHVCLQTGRDQFVDPFDPVMGTTSATRPYSEDLPRLEHPDLEDVLLIELPGFVASRRDRAPVTWSVHRPATVFGFSSRSGRNVVSSLCVYAAICRKEGAALRWPGSRVAWEGFSDASDAELVAEHALWAALELRCKNEAFNCTNGDVFKWKQLWPALAKHFAVEWSGYDGEDKRFKLEEAMAGKEAVWTEIVRENGLLETKLDDTTTWWSVDAVLNADQEQVDTMNKSKELGFFGFRHTVRSFDTWITKLKASGIVP

SEQ ID NO: 395 - protein, 366 aa, Medicago truncatula
MISDLSIYHFGAHHITEFKESPRSFQNVALIIGVTGIVGNSLAEILPLDDTPGGPWKVYGVARRPQPNLSPLTDVTHIFYVSWTSMPTEAQNCKVNGSMLRNVLRALIPNTLNLCHVSLQTGIKHYFGSFEIVGKIKPHESPFTEDVPRLVTPNFYHTQEDILLEEVGKKKGMTWFINRPQVIFGFSPYSMMNLIGTLCVYAAICKHEGLPLRFPGSKGAWECYSTASDANLISEQHIWGAVDPNAKNEAFNCSNGDVFRWKHLWKVLAERFEIDDYGFEEGSELRLSDLMKDKGGVWEEIVRENELLYTKLEEVGDWWFADFMFRVEGVLDSMNKSKEHGFLGFRNSKNVFISWIDKTKVYKIVP

SEQ ID NO: 396 - protein, 393 aa, Juglans regia
MITWLWARAVGATKKINEAEEAVLPPGSYQSVGLVIGVTGIVGNSLAEILPLPDTPGGPWKVYGVARRPRPKWNAKHPVHYIQCDVSNSEETEAKLSQLADVTHIFYVTWASRQTEAENCEVNGAMFRNVLRALIPNAPKLRHICLQTGAKHYIGPFEAFGKIQPHEPPFTEDLPRLNVPNFYYTQEDILFEEAKKKEGLTWSIHRPNIISGFSPYSMMNIIGTLCVYAAICKHEGLPLKFPGNKASWEGYSVASDADLIAEQHIWATVDPNARNEAFNCNNGDVFKWKHLWKVLAERFGIEKYGFEEGEKVSLVEMMKDKGPVWEEIVRKNHLQPTKLEEVGVWWFADLFLCVEGALDSMNKSKEHGFLGFRNSKTSLITWVDKMKGHNIVP

SEQ ID NO: 397 - protein, 334 aa, Triticum urartu
MKKIAGGKAFIMQSKHMKVNYLLLTQVRNSPGAFTDLPRSASDAAAYYRSEEGSSTEKVFWSQYAEAGHLVPLSDQLKQMVELHKPGRKHYIGPYEAIGKIPVPDPPYTEDMPRLDYPNFYYDQEDVLFEEVSRRDGAVSWSVHRPSVVFGFSPRSAMNVVASLSVYAAICRKEGAMLRWPGSRVAWEGFSDASDADLVAEQEIWAAVDPLARNEAFNCSNGDLYKWKQLWPMVADRFGVEWAGYEGEDSRFMLADAMAGKEAVWAEILQENELVTTELQEIANWWFLDAVFNVKCEHLDSMNKSKEHGFLGFRNTAKSFNAWIDKMKVLKIVP

SEQ ID NO: 398 - protein, 386 aa, Citrus clementina
MLVQNKLDEGEPSRDNQHVGLIVGVTGIVGNSLAEILPQPNTPGGPWKVYGVARRPRPAWNADHPIQYIQCDVSDADETQAKLSKLTDVTHIFYVTWASRPTELENCHVNGAMLRNVLRSVMPNAPNLRHVCLQTGGKHYLGPFDYFVDTQLPHHPHDPPYTEDLPRLNVPNFYYDQEDILFEEVAKRDGLTWSVHRPLGIFGFSPYSMMNIACTLCVYAAICKHEGVPLLFPGTKEAWDGFTEVSDADLIAEQQIWAAVDPNARNEAFNCANGDVFKWKHFWKVLAERFEIEDYGFDEKGERLRLVEIMKGKESVWEEIVRKNKLLPTKLNEVAIWWHADVSFDVGEDILVSMNKSKGHGFLGFRNSKNSFIAWIDKMKRYKIVP

SEQ ID NO: 399 - protein, 415 aa, Panicum hallii
MMRWCWTGAYGTIERRHIVARAAAEAEAAATASQKVALVVGSTGVVGAALLDILPSLDTPVGPWKVYALSRGPLPPWSAPAGAPSSSYPNPVIHLHLDLADPAAVAQALKPLTDITHVFYTAWSACPGATEDDAREASCAMLRNVLSVVVPRCPALVHVCLQTGRKGFVDPFEPMSGFFAAIVAMRPYPEDVPHLEHSDLEDVFLDEVAHSWLNGAAGAITWSVHRPATLFGFSPRSESNVIASLCVYAAICCKEGAALRWPGSLVAWEGFSDASDAELVAEHALWAALEPSGKNETFNCTNGDIYKWKNLWPMLADHFEMEWSGYDGEDKRFKLEEAMAGKEALWAEIVREKGLVETELNDITSWWFVDALINAGKEQIENMNKSKERGFLGFRNTVRSFNTWIGKLKADKIVP

SEQ ID NO: 400 - protein, 385 aa, Prunus persica
MNFKLQRKHEEDHEAPHTPKSVGLVIGVTGIVGNSLARILPQSDTPGGPWKVYGVARRPRPHWNSDYPMEYIQCDISDPKDTVSKLSRLTDVTHIFYVTWASRSTEPQNCEANAAMIRNVLRVVITNAPNLCHVCLQTGTRHYFGPYESLGKVEPQEPPCLEDLPRLNAPNFYYALEDVLFEEVGKKEDLNITWSVHRPGSIFGFSPYSLVNIVAMLSVYASICKHEKKPLRFPGSEAAWNCYSDVSDADLIAEQQIWAAVDPNAKNEAFNVNNGDVFKWKQFWTVLAEQFEIEEYGFDEEGGGFSLLEMMKEKEGVWEEIVRENQLEPTKLEEIGWWLLDLFFSGEGLMTSMNKSKEHGFLGFRNSRKSFVSWIDKNKAFKIVP

SEQ ID NO: 401 - protein, 384 aa, Tarenaya hassleriana
MNTIEAPKKKLDAEPHYRSVGLIIGVTGIVGNSLAGILPLSDTSGGPWKVYGVARRPRPDWTTDQQIQYIQCDVSDAIDVRTKLSPLTDVTHIFYVTWTNRETESENCSANAAMLRNVLRAVVPHAPNLRHVCLQTGTKHYAGPFDNVAGRSFHDSPFTEDLPRLSLRNFYYDQEDVLFEEVEKKEGLTWSVHRPNRIFGFSPYSLINMVGSLCVYAAICKHEGSPLMFPGSKAAWEGFTVASDADLVAEQEIWAATDPYAKNKAFNCNNGDVFKWKHLWKILAEKFEIEEYGFEEEEGREKVGLVKMMEGKDRVWGEIVKEKDLEKTKMEEMGEWWVVDLILRVEGMVDCMNKSKEHGFLAFRNSTKSFAYWIDKYRAHKIVP

SEQ ID NO: 402 - protein, 441 aa, Capsicum baccatum
MNVLVCLRDWIRAERRNQGIEKEPNDKQRLEEIMTSRENLAESSLMHGFAPIDFDYPMQQNVEYCGTHEISYQNVGLVIGITGVVGNSLAETLSSTDTPGGPWKVYGVSRRGKPVCSIAKVRYIQCDVSVSTDVQSKLSTLKDVTHIFWVTSAFDLSTAKCCEINGAMFRNVLNAVIPNAPNVCHICLQTGAMHYMEIQRSIDGKLHVISHDPPFTEDMERLENIHNFYYTLEDVLFDEVSRKPSLTWSIHRPDLIFGFSHHSMLNIVGTLCVYATICKHECIPLIFPGTKAVWDSYSNASDANLVAEHQIWAALGAQGKNKAFNITNGDVFKWKQLWKVLAEQIGVEYVGFDETEKIISLSEMMKDKGTVWEKIVRDNNLISTTLQEVGLWDFADMLLAGGTSRLCSINRSKEHGFFGFRNSINSFIFWIQKAKDNRLIP

SEQ ID NO: 403 - protein, 390 aa, Medicago truncatula
MNWWLARATGDHPGKITKFKEAPRNVQNVALIIGVTGIVGNSLAEILPLKDTPVGPWKVYGVARRPRPMWNVDNPVHYIQCDVSNQNDVELKLSPLTDVTHIFYVSWTSRPTEAQNCEVNGAMLRNVLQALIPNAPNLSHVSLQTGAKHYVGPFEIIGKIKPHESPFTEDVPRLDTPNFYYTLEDILFEEVGKKKGTTWFINRPQVIFGFSPYSMMNLIGTLCVYAAICKHEGLPLRFPGSKGAWECYSTASDANLISEQHIWGAVDPNAKNEAFNCSNGDVFRWKHLWKVLAERFEIDDYGFEEGSELRLSDLMKDKGGVWEEIVRENELLYTKLEEVGDWWFADFMFRVEGVLDSMNKSKEHGFLGFRNSKNSFISWIDKTKAYKIVP

SEQ ID NO: 404 - protein, 395 aa, Nicotiana sylvestris
MNWWWSRSTNTTQQNVDYYETTNHESNQNVGLVIGVTGVVGNSLAETLSSTDSRGGPWKVYGVARRETPVRNAKVTYIQCDVSVATDTQAKLSTLEDVTHIFWVTSAFDLSMAKHCEINATMLHNVLNAIISNAPNLRHICLQTGAMHYMGIHRSVDGKIHTISHDPPFTEEMERLENIHNFYYTLEDVLLDEISRKPSITWSVHRPDLIFGFSPHSTLNIVGTLCVYATICKYERVPLTFPGTKVRWDSYSNASDADLVAEHQIWAALCPRAQNKAFNITNGDVFKWKHLWKVLAEQIGVEYVGFNETEKHICLAEMMKDKGHVWDKIVRDNNLVSTTLEEVGLWQFADMILAGGSNRLSSINRSKEHGFMGFRNSTNSFIFWIQKAKDNRLIP

SEQ ID NO: 405 - protein, 366 aa, Oryza sativa
MPPMSMSWWWAGAIGAARKRHDGGGGEQQPPFRSVALVVGSTGIVGTSLVDILPLPDTPGGPWKVYALSRRPPPPWSPPPPAAVTHLCVDLADAAAVAEALAPLTDITHTGSKHYIGPPESIGKLPVETPFSEDMPRHDYPNFYYDQEDVLFDAVTSSSSSSSSRRAAAVTWSVHRPSLIFGFSPRSAMNVVCSLCVYAAICRKERRELRWPGSLGAWEGFSNASDADLVAEQQIWAAVADAAAKNEAFNCSNGDIYKWKQLWPVLAGKFGVEWAGYEGEERRVGLTAAMAGKEAVWAEIVAEEKLVATELGEVANWWFVDALFMDKWEFVDTMNKSKEHGFLGFRNTLRSFEAWIDKMKLYRIVP

SEQ ID NO: 406 - protein, 410 aa, Oryza sativa
MPPMSMSWWWAGAIGAARKRHDGGGGEQQPPFRSVALVVGSTGIVGTSLVDILPLPDTPGGPWKVYALSRRPPPPWSPPPPAAVTHLCVDLADAAAVAEALAPLTDITHVFYVALAAPHLAEARSREANAGMLRNVLAAVVPTCPALAHVALQTGSKHYIGPPESIGKLPVETPFSEDMPRHDYPNFYYDQEDVLFDAVTSSSSSSSSRRAAAVTWSVHRPSLIFGFSPRSAMNVVCSLCVYAAICRKERRELRWPGSLGAWEGFSNASDADLVAEQQIWAAVADAAAKNEAFNCSNGDIYKWKQLWPVLAGKFGVEWAGYEGEERRVGLTAAMAGKEAVWAEIVAEEKLVATELGEVANWWFVDALFMDKWEFVDTMNKSKEHGFLGFRNTLRSFEAWIDKMKLYRIVP

SEQ ID NO: 407 - protein, 379 aa, Cynara cardunculus
MRKLEDGNPSRKYQKFALIIGVTGIVGNSLAEILPLHDTPEGPWKVYGVARRPRPSWNDDYPIDYIQCDVSDPEQTQSKLSTLTDLTHLFYVTWANCETESENCDINGKMFTNVLNAVIPNAPNLQHICLQTGRKHYIGSLEAIMAKKFVHDPPFHEDLPRLDSPNFYYTLEDILFKEVEKKEGLTWSIHRPGVIFGFSPNSMMNILLGLCAYASICKHEGQPLTFPGTKEAWNSFTDASDADLIAEHQIWAAVDPIAKNEAFNISNGDVFKWKHLWKILAEQFEVENGGFREDGEKKSLGEMMKDKGGVWDEIVKEKGLLVNKLEEVGKWWFVDVVLSNEGMLDIMNKSKEHGFLGFRNTKSCFVSWIDKIKCSKIVP

SEQ ID NO: 408 - protein, 391 aa, Ornithogalum longebracteatum
MRWWWAGAIGAAKRSMDSTPPQGPTYQSVALVVGATGIVGSSLIDILPLSDTPGGPWKLYAISRRPLDSSSPSVVHVQCDVADPDETLAMLSPLSDVTHVFYAAWAHRPSEHDNITVNSAMLRNVLAAVVPNAPNLQHVCLQTGRKHYVGSFEYLGKIQGHEPPFHEDLPRLDSPNFYYNQEDILFEESEKTDGRVSWSVHRPTTIFGFSAISKMNIMQSLCIYAAICRKERALLRWPGSRVTWEGFSDASDADLIAEHQIWAAVDPYAKNEAFNCSNGDVFKWKQLWRTLAEQFEVGFVGYEGEEGRFSLEEAMRGKEEVWAEIVRESELVETRLEDVGNWWFVDAVLGVEFEHLDTMNKSKEHGFLGFRNTMNSFISWIDKMRAFKIVP

SEQ ID NO: 409 - protein, 397 aa, Allium ursinum
MRWWWAGAIGAARKTLDSSSASNSNTSIPPPQSIALVIGATGIVGTSLLDILPLADTPGGPWKLYAVSRRPLVSDNPKVHPVQCDISDSAQTLERLSPLSDVTHIFYVALAQCPTEAENIAANSAMLRNVLNSVIPNAPNLQHICLQTGRNHYSGAFEFAGKVKPHDPPFYEEMLRLNSPNFYYNMEDILLEEVEKRDGVRCHGSVHRPTIIFGFSTRAAMNIVQGVCVYAAICKNGGKALRWPGSRVTWEGFSDASDADLVAEHQIWAAVDPYAKDEAFNCSNGDVFTWKQLWKALAEQFELEWVGYEGEDKSFSLEKEMRGKEAVWKELVRENELVDTKLEEVGNWWFLDLVLGAEIEHLDSMNKSKEHGFLGFRNTLNSFNSWVDKMKAFKIVP

SEQ ID NO: 410 - protein, 398 aa, Convallaria majalis
MRWWWAGAVGAARKKIDDGPPAAPKFQSVGLIIGDIGLVGNSLAEILPLSDTPGGPWKVYGVSRGPKPPPSDPPTFGSFDHVACDVSNLDRTLEKLSPLAADVTHLFYVGDDEESDPTANSSMFRNVLEAVLPSAPNLQHICLLTGLEHYLGPLEAWGKIPAHDPPFREDLPRLDAPNYCYDLEDVLLESVKDEWGGRGTWFGPPAPPHSIFGFSTKCSMNLIGTLCVYASICRKEKVPMRYGPGNRVQWEGFSEASDADLVAEHQIWAAVDPYAKNEAFNCNNGDVFKWKHMWKVLAEQFGVEFVGYEGEDGERARLADAMKGKEEVWEEIVRENELVPTKLEVVGNWEFVDTMLNAEDSYLSSMNKSKEHGFLGFRNSVSSFISWIDKAKAFKIVP

SEQ ID NO: 411 - protein, 391 aa, Populus trichocarpa
MSCWWAGALGNNRKKFYDDDEASRDYKSVALVVGVTGIVGNSLAEILPLADTPGGPWKVYGVARGKRPNWNEDNPVEYIQCDISDRNQTQSKLSLLTDVTHIFYVTWANRETESENCKINGLMFRNVLEAVILNAHNLRHICLQTGTKHYVGPFQFFGKIEAHDPPFTEDLPRLEFPNFYYTLEDILFQEVAKKEGLTWSVHRPDNIFGFSPHSLMSIVRTLCVYAAICKHEGTLMRFPGVKEVWNCYAIASDADLIAEHEIWACVDPSAKNEAFNIHNGDVFKWKHLWKVLGEQFGLEEYGFVETEERISLAETMKEKGAVWEEIVRENQLLPTKLEEVGAWWFVDLIFGGEVSIPSMNKSKEHGFLGFRNSKKSFISWIEKMKASKVVP

SEQ ID NO: 412 - protein, 408 aa, Sorghum bicolor
MSLPPHLHFDFDQELEHKMECEGTKKVVLVIGSTGIVGSALINLLLLENPKNPVGSCKKVYALSRRPMPPWYMTASSSSFSSNNDPIPTVIHLHVDLADDAAVTKALAPLTDITHVFYVTWAPRHGWSNTEAHTVNRAMLSSVLSAVIPNAPDLKHVALQSGRNQSADPFQPPVRGAFAEDGWLGPFSEDLPRPDYPDLEDALIDGIASRVGDVTWSVHRPATILGFSPRSSRNLVSSLCVYAAICSKEGAVLRWPGSLVAWEGFSDACDAWLIAVQAIWAAMMARPNEAFNCGNGDVFKWKQLWPILASYFGVPWAGYEGEDQRFKLEEAMVGKEPVWAEIINENGLVETELDDITTWWLVDAVVNAEKEHVETMNKSKEFGFHSIYDTVRCFDTCIRKMKASRIVP

SEQ ID NO: 413 - protein, 401 aa, Zea mays
MSLSWWWTRSVGADRERKDELAAVPEHSFQSVALVVGSTGIVGASLVDIIPRADTPGGPWKVYALSRRPPPPWSLPSSSSLTHINVDLTDSATVAEALTPLTDITHVFYVAWSPRATEAENREANSAMLRNVLSVVVPNCPALAHVSLQTGIKHYLGPFELIGKIPTPDPPYTEDVPRLDCPNFYYDQEDVLFAAVSRRGGAVSWSVHRPNLILGFSPRSFFNVVCSLCVYASICRKEGVALRWPGCLGSWESFSNASDADLIAEQHIWAAVDPMAKNQAFNCNNGDLYNWKMLWPVLAARFGLEWTGYDGEEKQFKVSEAMAGKEAVWAEIVRENGLVETRLYDVADWWFIDFVVYEHSADSKLLDSMNKSKEHGFLGFRDTVKSFGKWIDKMKAYKIIP

SEQ ID NO: 414 - protein, 387 aa, Daucus carota
MSLWWSGAVAAAKKRMGQLEYASAPSRYNSVALVVGVTGIVGNSLAEILPLSDTPGGPWKVYGVARRPRPPWKVDERVDYIQCDICDLDETRLKLSMLQDITHVFYVTWANRPNESENCEINGKMLRNVLNALIPNSPNLKHICLQTGRKHYVAPGSEDHDPPYTEDLPRLDSPNFYYILEDILFEQVGKKEGLTWSVHRPAPIFGFSPYSLMNIIGTLCVYATICKHEGVPMRFPGTEEAWNCYSDASDADLIAEHQIWAAVDPYAKNEAFNCSNGDVFRWKHFWKVLGQQFEVECGYLEAGERLSLAEMMKDKGPVWDKIVKEKGLVPTKLEEVAAWWFADGMFSGPCPLISMNKSKEHGFFGFRNSKSCFIYWIDKMRSYRVVP

SEQ ID NO: 415 - protein, 397 aa, Nepeta cataria; identical to SEQ ID NO: 372

SEQ ID NO: 416 - protein, 394 aa, Catharanthus roseus
MSMRWWWAGGAIGAAKKKLQVDDGPPKHQSVGLILGVTGLVGNSLAEILPLSDTPGGPWKVYGVARRSRPTWHADHPIEYIQCDLSNPEETESKLSNLTDVTHIFYVTCVTANKYTDAENCDANGKMFRNVLNAIIPNCPNLQHICLQTGLKHYFGRSLVGNFVCHESPCYEDLPRLDVPNFYYTLEDILYEEVQKKEGLTWSVHRPGTIFVFSPFSSMNLVGTLCVYAAICKQQGLPLKFPGSKNVWEGYSMCSDADLVAEQQIWAAIDHLPNAKNEAFNVSNGDVFKWKYIWKVLAEQFGLEFVEFDGEKLSLQEMMIDKGPIWEEIVRENGLLGTKLEQVGVWWFADVLLGFEFPLDSMNKSKEHGFLGFRNSKNSFLSWIEKTKAYKIVP

SEQ ID NO: 417 - protein, 401 aa, Dichanthelium oligosanthes
MSMSWWWAGAIGAVSKRQDDHAAVSPSQHGFQSVAVVVGSTGIVGTSLVDILPLPDTPGGPWKVYALSRRPLPPWSLASSPSSVTHIHVDLTDSAAATEALTPLTDITHVFYVAWTWRATEEENCEANSAMLRNVLSVVVPNCPSLVHVTLQTGTRHYFGRYSENPVHDTPYTEDMPRLDMPVFYYDQEDVLFDAVERRGKTVSWSVHRPNIIFGFSPRCAINLVCSLCVYAAICRKEGAPLRWPGSCGGWEGFITPSDADLVAEHHIWAGVEPMAKNEAFNCSNGDVCTWKKLWPILAGRFGLEWAGYEGEENRFKLTEAMAGKEELWAEIVEENELVATHVSEVANWWVIETSADQYGLNSPILDSMNKSKEHGFLGFRNTFKSFNACIDRLKAHRIVP

SEQ ID NO: 418 - protein, 413 aa, Sorghum bicolor
MSMSWWWRGAIGATRRRQDEHATATTERRPFQSVALVVGCTGIVGASLVDILPLPDTPGGPWKVYALSRRPLPPWWQYRHPPSSSSSVVTHLQVDLTDSAAVAKTLTPLTDITHVFYAALSAPSTVDEAKNREANSAMLRSVLAAVVPNCPRLRHVCLQTGTKHYMGPPASFGRRTTAHDPPYTEDMPRLDWPNFYYDQEDVLLDAVAAGAGAVTWSVHRPSLVFGFSPRSAMNVVCSLCVYAAICRKDGVPLQWPGSLGAWEGFSNASDADLVAEQQVWAAVVDHPMGMAKNEAFNCSNGDVFRWRQLWPILAGRFGVEWAGYRGEENRVKLVDAMAGKEPVWAEIVEESQLVPTQLHEVANWWFVDALFCAKWEFLDSMNKSKEHGFLGFRNTAKSFDNWIDKMKACKIVP

SEQ ID NO: 419 - protein, 380 aa, Tarenaya hassleriana
MSRQIYHKNVALIIGVTGLVGNSLSEILLKPETNGGPWKVYGVARRPRPRWNSDCRIEYIQCDVSDAETTRRKLSCLTDVTHVFYVTWASRETEAECCDANAAMLRHVLTAVAPSLRHVVLQTGTKQYVGPYESLGRIRTHEPPFSEDLPRLPYPNFYYALEDVLCQELEKTDQSVSWSVHRPNVVFGFSPYSLANIVFSFCIYAAVCKHEGVPMYFPLSKTTWECYSVASDADLIAEQEIWAAMEASCKNEAFNCSNGDVFKWKQLWGILAESFGIEEYGFEEGKNLGLVEMMKDKGNAWREIVEKHGLEETELDDGIVGSWKIVDAVMAEGGLLDCMKGDGILDSMNKSKEFGFLSFRNSKKSFVHWISKYKDHKIVP

SEQ ID NO: 420 - protein, 425 aa, Citrus sinensis
MSRRWWAGAVDAPKKQKPNLSSIFQNHQKKSWSWSWSWASDIGAPKKKLDEDKRPRDYQLVGLILGVTGIVGNSLAEILPRSDTPGGPWKVYGVARRPRPDWNANHPIEYIQCDISDQEETQAKLSKLTDVTHIFYVTWASRPTEVENCQINGSMFRNVLRSIIPNAPNLRHICLQTGGKHYLGPFDCIGKIPYDPPFTEDLPRLNIPLFYYNQEDILFEEVEKREGLTWSIHRPFGIFGFSPYSLMNIIATLCMYAAICKHEGIPLLFPGTKETWEGFSEYSDADLIAEQQIWAAVDANARNEAFNCTNGDVFKWKHLWKALAEQFEIENYGFGDEKDSERMRLGEFMKGKESVWEEIVRENQLQPTKLNEVAVWSYADMGLNIGAGYLVSMNKSKEHGFLGFRNSKNSFVTWIGRLKSHRIVP

SEQ ID NO: 421 - protein, 399 aa, Picea sitchensis
MSSFSWWAGSLGHGVRKFETKGESSEDKSEKQQGVALVIGVTGIVGNSLVEILPLSDTPGGPWKIYGVARRPKPDWSPDTPVEYIQCDVLDRKLTLEKISPLKDVTHLFWVVWVSRETEEQNCEDNGRMLSNVLDALLPNAENLQHICLQTGAKHYLGPFDAVARNRYFQPHEAPYHEELPRLPVPNFYYTLEDIVFEAAKKKDGLTWSIHRPSFIFGFSPWSLMNILGTLCVYAAICKHEGLPFKYPGNRITWEQFVDISDAELIAEQEIWAATYPHAKNQAFNCSNGDVLKWKRLWGIIAEKFDLEPLPYKGEGFSLAEAMKDKGPVWDALVRENKLHPTKIEEVGNWWFADFTLNLPQETVHSMNKSKEYGFFGFRNTETSLGQWIDKMKASNVVP

SEQ ID NO: 422 - protein, 339 aa, Cajanus cajan
MSVGLVIGVTGIVGNSLAEILPLADTPGGPWKVYGVARRPRPPWNADHPVEYIQCDVSDPADADAKLAALSDVTHVFFVSWTNRPTESENSEVNGAMLRNVLRAVIPNAPNLRHVSLQTGTKHYLGPFELIGKIESHEPPFTEDLPRLDAPNFYYTQEDILFDEVSKKEGLTWSVHRPQTIFGFSPYSLMNVVGTLCVYAAICKHEGVPLRFPGTRSAWEGYSCCSDADLIAEQHIWAAVDPYARNEAFNCSNGDVFRWKHLWKVLAEQFGIEDENQLLPTNLDEVGLWWFVDVIFSVEGMGLLDSMNKAKEHGFLGFRNSKNSFVSWIDKTKAYKIVP

SEQ ID NO: 423 - protein, 344 aa, Citrus clementina
MSWFWAGAIGAAKNVGLVIGVTGIVGNSLAEILLRSDTPVGPWKVYGVARHPRPNWNDDYPVEYIQCDVSDQEDTQAKLSKLTDITHIFYVTWASRRTEAENCQINGAMFHNVLSSVIPNAPNLRHICLQTGGKHYVGPFEFVGKIPSHDPPFTEDLPRLNVTLFYYTLEDILFKEIDKREGLTWSVHRPHGIFGFSPYSLMNITATLCVKFWAAVDPNARNEAFNCTNGDVLKWKHLWKVLAEQFEIENYGLEDGKCSERVRLEEIMKGKESVWEEIVRENQLQPTKLNEVAVWSYADTVMNVGAGYLVSMNKSKEHGFLGFRNSISSFVTWIGRLKSHKIVP

SEQ ID NO: 424 - protein, 389 aa, Aquilegia coerulea
MSWRWSGANGAAKNKLEEDEVPSNYQSVGLVIGVTGITGNSLAKILPLSETPGGPWKVYGVARRPRPTWNTEYPIEYIQCDITNKDETLLKLSSLTDITHIFYVAWTPCPTDAENCQVNSKMLRNVLQAVVPNAPNLKHICLQTGIKHYTGDFESFGKNLAHDAPFCEDLPRLDTPNFYYTQEDILFEEIDNKEGLTWSIHRPALIFGFSPYSLMNVIGTLCVYAAICKHEGKKLQFPGPRAAFEGYFDASDADLIAEHQIWASVADQHAKNEAFNCTNGDVFQWKHLWKVLGEQFGIECAEFEEGVSLQELMKDKGPVWDEIVKENKLCPTKLEEVGAWWVVDTFFSWKELGLSSMNKSKEHGFFGFRNSTTSFISWIDKMKVYKIVP

SEQ ID NO: 425 - protein, 388 aa, Lonicera japonica
MSWWCKWSIGAGKNLPNQNKENGVCKSYKSVALVVGVTGIVGSSLAEVLKLPDTPGGPWKVYGVARRPCPVWLAKKPVEYIQCDVSNNQETISKLSPLKDITHIFYVSWIGSEDCQTNATMFKNILNSVIPNASNLQHVCLQTGIKHYFGIFEEGSKVVPHDSPFTEDLPRLNVQNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIL

SEQ ID NO: 426 - protein, 392 aa, Olea europaea; identical to SEQ ID NO: 377

SEQ ID NO: 427 - protein, 392 aa, Thlaspi densiflorum
MSWWGAGAIGAAKKKFDDDEPTQSYESVALIIGVTGIVGNSLAEILPLSDTPGGPWKVYGVARRPRPSWNADHPIDYIQCDVSDAEDARSKLSPLTDVTHVFYVTWTSRSSESENCEANGSMLRNVLGAIVPNAPNLRHVCLQTGTKHYLGPFDSAGDESVHRHESPFTEDMPRLQIPNFYYTLEDILFEEIKKKEGVTWSIHRPNTIFGFSPYSLMNIVGTLCVYAAICKHEGSPLLFPGSKKAWEGFTTASDADLVAEQQIWAAVDEFAKDQAFNCNNADIFKWKHLWKVLAEQFGIEEYGFEEGKNVGLVEMMKGKERVWEEMVKENQLQEKKLEEVGVWWFADVILGVEGMIDSMNKSKEHGFLGFRNSNNSFVSWIDKYKAFKIVPL

SEQ ID NO: 428 - protein, 390 aa, Stellaria media
MSWWGAGAIGAAKKKIDEDDDEPQSYQSVGLIVGVTGIVGNSLAEILPLADTPGGPWKVYGVARRPRPEWNTDHPIQYIQCDVSDPDDALSKLSPLTDVTHIFYVTWTTKSSEIENCRANVSMLRNVLQAVIPNAPNIQHVCLQTGAKHYVGPFDSFGKIQPHEPPFTEDMPRLPVPNFYYDLEDALFEEVQKKEGVTWSVHRPTTIFGFSPYSLMNIVGSLCVYAAICKYEGKPLVFPGTKAAWEGFAVASDADLIAEQRIWASVDPFAKNEAFNCNNGDVFKWKHLWKSLAEQFGIEDYGFEEGKNVGLKTMMDGKQSVWEEIVRKNQLQETKLDEVGSWWFVDIILGVEGALDSMNKSKEHGFAGFRNPKNSFVSWIDKCKAFKIVP

SEQ ID NO: 429 - protein, 389 aa, Erysimum crepidifolium
MSWWGAGAIGAAKKKLDDDEPSQSYESVALIIGVTGIVGNSLAEILPLSDTPGGPWKVYGVARRPRPSWNADHPIDYIQCDVSNAEDARSKLSPLTDVTHVFYVTWTKRESESENCEANGSMLRNVLQAIVPHAPNLRHICLQTGTKHYLGPFSNLDGPRHDPPFTEDMPRLQIQNFYYTQEDILFEEIKKKEISVTWSIHRPNTIFGFSPYSLMNIVGTLCVYAAICKHEGSPLLFPGSKKAWEGFTTASDADLIAEQQIWAAVDPYAKNEAFNCNNADIFKWKHLWKILAEQFGIEEYGFEEGKNLGLVEMMKGKERVWEEMVKENQLQEKKLEEVGVWWFADVILGVEGMIDSMNKSKEHGFLGFRNSNNSFISWIDKYKAFKIVP

SEQ ID NO: 430 - protein, 378 aa, Morus notabilis
MSWWLAGAIRAAKKKREYDYAPSEYQSVALVVGVTGIVGNSLAEILPLSDTPGGPWKNADHPITYIQCDVSDPQQTKDHLSKLTDVTHIFYVTWSSQPTEAENCSVNGAMLGNVLEAVIPHAPNLQHICLQTGRKHYIGPFELLGKVEPHEPPFHEDLPRLDAPNFYYVQEDILVEEVKKKEGLTWSVHRPGVIFGFSPSSLMNIIGSLCVYAAICKHEGMKLRIPGTREGREAYLDASDADLIAEHQIWAAVDTYAKNEAFNCSNGDVFKWKHMWKVLTEQFELEYEEFEDDGDSLTLVEMMKDKGEVWDQIVKENGLVPTNLEEVGNFWFADLVLTLGTTLDSMNKSKEYGFVGFRNSKSSFISWIDKMKSYKIVP

SEQ ID NO: 431 - protein, 392 aa, Helianthus annuus
MSWWLSGVVGATRRKRGDTNPSLKYKGFALIVGVTGIVGNSLAEILPLHDTPGGPWKVYGVARRPRPPWNADYPMEYIQCDIRDEEQTLTQLSNLQDLTHVFYVTWANCSNEQHNCEINGQMFKNVLNAVIPNCPNLQHICLQTGRNHYIGPFDDWGTLNGVQDAPFCEDLPRIENPNFYYTLEDILFKEVTKKEGLTWSVHRPGVIFGFSPCSMMNIVGSLCVYAAICRHEGEPLRFPGTRQAWESYHSASDADLIAEHHIWAAVDEYAKNEVFNISNGDVFKWKHFWKVLAEQFGVENGGLQEEGERRSLSDMMKDKGAVWDAIVTEKELLPTKLEEVGGWWFVDVVLGNEGMLDLMNKSKEHGFLGFRNSKSSFVSWIDKIKCSKIVPI

SEQ ID NO: 432 - protein, 323 aa, Capsicum annuum
MSWWRAGANGAAKKKFKEDDAPAKYESVALIIGVTSIVGNSLAKILPLADTPSGPWKVYGVAHRSRSSWNADHSIEYVQCDISNPEGHDSPFHEDLPRLVEPNFYYVLEDILFKAVEKKEGLTWSVHRPGTIFGFSPYCLMNIVGTLCVYAVICKHEGLPLKFPGVKEAWDVYSDCSDADLIAAHQIWPAVDPYAKNEAFSVSNGDFFKWKHFWKVLAEQFGVEPAECYEGKRCTLTKMMKDKGTVWDEIMKENGLVPIKLEEVGVWWFVDLMLAGDCPLDTMNKSKEHAIFAVHMALKSIIDKITIDTPDWTCKVQIVESLT

SEQ ID NO: 433 - protein, 407 aa, Macleaya cordata
MSWWWAGAIGAAKAKFLIPNLSLSLLLFCFFKKFEEDEVPPKYQSVGLIIGVTGIVGNSLAEILPLSDTPGGPWKVYGVARRPRPPWNADHPIEYIQCDVSDSDETLSKLSPLTDVTHIFYVTWTSRKTESENCEANGAMFRNVLRALIPNAPNLQHICLQTGRKHYLGPFEKLGEEIEHQVLPLHEDLPRLKTPNFYYTLEDILFEEVEKKDGLTWSVHRPGTIFGFSPYSVMNLIGTLCVYAAICKHEGTPLRFPGTRVAWEGYSDASDADLIAEHQIWTSVDPYAKNEAFNCSNGDVFKWKHLWKVLGEQFEVECAEFEEGLKLGEMMKDKGPVWDEIVKQNDLCPTKLEEVGAWWFVDTMFGAKESILDSMNKSKEHGFLGFRNSNSAFVSWIDKMKAFKIVP

SEQ ID NO: 434 - protein, 388 aa, Citrus clementina
MSWWWAGAIGAAKAKSYSKFINKLEEYEQTRDYQSVGLVVGVTGIVGNSLAEILPRPDTPGGPWKVYGVARRPRPNWNAAYPVEYLQCDVSDQEDTQAKLSKLTDVTHIFYVTWDGRRTEAENCQINGAMLHNVLRSVIPNAPNLRHICLQTGGKYYMGPLEFIGKIPSHDPPFTEDLPSLNISLFYYTLEDILFEEVDKREGSTWSVHRTFGIFGFLSFGVLMNIIATLCVYAAICNHEGVPLLFYGTIDTWEGFQQVSDAELIAEQQIWAALDSNARNEDFNCTNGDFEIEDYGLEDGKGCERVRLEEIMKGKESVWEEIVRENQLQPTKLNEVAVWSFADTVMNMGAGYLVSVNKSKEHGFLGHRNSKNSFVTWSGRLKSHRIVP

SEQ ID NO: 435 - protein, 392 aa, Arachis ipaensis
MSWWWAGAIGAAKATKKFEDDEPPRSFQSVGLIIGVTGIVGNSLAEILPLADTPGGPWKVYGVARRPRPSWNVDHPIEYIQCDISDPNDTQSKLSALTDVTHIFYVSWTRRPTEAENCQVNGAMLRNVLQAVIPNAPNLRHVSLQTGGKHYLGPFELFGKIQPHEPPFTEDLPRLKAPNFYYTQEDILYEETQTKDGVSWSVHRPQVIFGFSPYSLMNMVGTLCVYAAICKHERVPLRFPGTKSAWEDYTTASDADLIAEQHIWAAVDAYARNEAFNCSNGDVFKWKHLWKVLAEQYGITEYGFDEGSERLKLSEMMRDKGPVWDEIVRENQLSPTKLEEVADWWFVDVMFGGAGLLDSMNKSKEHGFLGFRNSKNSFISWIDKTRAFKIVP

SEQ ID NO: 436 - protein, 391 aa, Vitis vinifera
MSWWWAGAIGAAKKKFDEDDAPRGFQNVGLVIGVTGIVGDSLAEILPLSDTPGGPWKVYGVARRPRPDWNADHPVEYTQCDISDSEDALAKLSPLTDVTHVFYVTWTNRATEIENCEANGTMLRNVLRALIPNAPNLRHICLQTGGKHYIGPFEAFGKIKPHDPPYHEDLPRLDAPNFYYTLEDILFEECEKKDDLTWSVHRPVIIFGFSPYSMMNILGTLCIYAAICKHEGIPLKFPGSKAAWDCYSDASDADLIAEQQIWATVDPYARNEAFNITNGDLFKWKHLWKVLAEQFDMEYAEFEEGEEKQSMVEMMKDKGPVWEEIVREKELLPTKLEDVAQWWFIDLVLGGESLLNCMNKSKEHGFLGFRNSRNSFVWWIDKMRGHKLIPP

SEQ ID NO: 437 - protein, 390 aa, Hevea brasiliensis
MSWWWAGAIGAAKKKFDEDDAPRSFQSVGLVLGVTGIVGNSLAEILPLSDTPGGPWKVYGVARRPRPNWNADHPVEYVQCDISDQAETQAKLSQLTDVTHIFYVSWANRSSEAENCEINGSMLRNVLQAVIPNAPNLGHICLQTGTKHYVGPFELFGKIQPHDPPFTEDLPRLNVPNFYYTLEDILFEEAAKKEGLTWSISRPDQIFGFSPYSLMNIIGTLCVYAVICKHEGLPLLFPGTKQAWNCYSIASDADLIAEQHIWASVDPYARNEAFNCNNGDVFKWKHFWKILAEEFGIEKYGFEEGEKRLSLVEIMKDKGPVWEEIVREYQLHPTKLEEVGVWWFADLILGGEAVISSMNKSKEHGFLGFRNSKNSFIYWIDKMKAYKIVP

SEQ ID NO: 438 - protein, 389 aa, Dorcoceras hygrometricum
MSWWWAGAIGAAKKKFDEDENPAKHQSVALIIGVTGIVGNSLAEILPLSDTPGGPWKVYGVARRPRPAWNDDNPTNYIRCDVSDADDVQEKLGSLTDITHVFYVTWASLSTEAENCEVNGRMLSNVLDVVIPNCPGLKHISLQTGRKHYFGPVESFGKIAIHDPPFDESLPRLDHINFYYTLEDILFAVVGKKEGLTWSVHRPGTIFGFSPYSLMNLVGTLCVYAAICKHEGMPLRFPGSKSAWDGYSDCSDADLIAEHHIWAAVDPYAKNEAFNVSNGDVFKWKSFWKVLAEQFDVEYAEFQEGQKLKLQEVMKDKGSVWDQIVRDNGLTPTKLEDVGNWWFSDLVLSSEGLLDTMNKSKEHGFLGFRNSKNSFVSWIDKVKAYKIVP

SEQ ID NO: 439 - protein, 390 aa, Brassica napus
MSWWWAGAIGAAKKKFDEDEPTQTYESVALIIGVTGIVGNSLAEILPLSDTPGGPWKVYGVARRPRPTWNADHPIDYIQCDVSDEEDARSKLSPLRDVTHVFYVTWTNRSVESENCKVNGSMLRNVLRAVVPNAPNLRHVCLQTGTKHYLGPFDSVGKAVDRHEAPFTEDMPRLKVDNFYYTLEDVLSEEIKMKESVTWSVHRPNTIFGFSPYSLMNIVGTLCVYAAICKHEGSKLVFPGSKEAWEGFTTASDADLVAEQQIWAAVDPYAKNEAFNCSNADVFKWKHLWKILAEQFGIEEYGFEEGKNVGLVEMMKGKERVWEEMVKENQLQVKKLDEVGVWWFADVVLGVDGMIDSMNKSKEYGFLGFRNSNNSFISWIDKYKAFKIVP

SEQ ID NO: 440 - protein, 389 aa, Ziziphus jujuba
MSWWWAGAIGAAKKKFDSDNAPAKHHSVALVVGVTGIVGNSLAEILPLSDTPGGPWKVYGVARRPRPPWNADHPIHYIQCDVSDSQQTNEKLSDLTDVTHIFYVAWTSRPTEAENSDINGRMLLNVLNTVIPIAPNLLHICLQTGRKHYMGPFELLGKIKPHEPPFHEDLPRLKVPNFYYTQEDILLAEVNKKQGLTWSVHRPGVIFGFSPYSLMNIVVSLCAYASICKHQGQALKFPGSQAAWDGFCDASDADLIAEHEIWAAVDPFAKNQAFNCSNGDVFKWKHLWEVLAEKFGLEYSAEFDVKLTLEEMMKGKDWVWDEIVKEKNLVPTKLEEIGGWWFADIILGLNELHLDSMNKNKEYGFVGFRNSKTSFGSWIDKIKSYRIVL

SEQ ID NO: 441 - protein, 394 aa, Punica granatum
MSWWWAGAIGAAKKKFEEDDAPKSFQSVGLVVGVTGIVGNSLAEILPLADTPGGPWKVYGVARRPRPSWNADHPVEYIQCDISDPQDAESKLSVLTDVTHIFYVTWTNLIAEVENCEVNGRMLRNVLRAVLPNAPNLCHVCLQTGQKHYIGNFEDMATGKVRPHEPPYTEDLPRLDCPNFYYTLEDILYEEVAKKDGVSWSVHRPPVIFGFSPYSLMNMVGSLCVYAAICKHEGTPLKFPGTKETWECYCIAGDADLIAEQQIWAAVDPYARNEAFNCSNGDVFRWKHFWKVLAEQFGIEEYGFYKKEGKLGLEEAMKGKEKVWEEIVRENQLQPTKLEEVGIWWFVDLVLSGDAGLDSMNKSKEHGFLGFRNSRNSFIYWIDKVKGYKIVPGA

SEQ ID NO: 442 - protein, 391 aa, Capsicum baccatum
MSWWWAGAIGAAKKKFEEDDAPPKYDSVALIIGVTGIVGNSLAEILPLADTPGGPWKVYGVARRFRPSWNADHPIEYVQCDISNPEDTQSKLSVLTDVTHVFYVTWANRSTEVENCEINGKMFSNVLNVIIPNCPNLRHICLQTGRKHYLGPFELFGKVGKVGHDSPFHEDLPRLDAPNFYYVLEDILFKAVAKKEGLTWSVHRPGTIFGFSPYSLMNIVGTLCVYAAICKHEGLPLKFPGVKAAWDGYSDCSDADLIAEHQIWAAVDPYAKNEAFNVSNGDVFKWKHFWKVLAEQFGVEPAEFDEGKRCTLTEMMKDKGTVWDEIVKENGLVPTKLEEVGVWWFVDLMLAGDCPLDTMNKSKEHGFLGFRNSQKAFISWIDRVKAYKVVP

SEQ ID NO: 443 - protein, 389 aa, Carica papaya
MSWWWAGAIGAAKKKFEEDDAPRSFQSVALVVGVTGIVGNSLAEILPLSDTPGGPWKVYGVARRPRPTWNADHPIEYIQCDVSDMEETRAKLSPITDITHIFYVAWSNRSTERENCEVNGAMLRNVLQVVIPNSPNLSHICLQTGAKHYVGPFETLGKIQFHDPPFTEDMPRLDTPNFYYTQEDILFEEVEKKENLTWSIHRPLVIFGFSPYCMMNMVGILCVYAAICKHEGSPLIFPGSKASWDSYSTVSDADLIAEQQIWAAVDPYAKNEAFNCSNGDVFKWKHFWKVLAEQFGIEEYGFNEGKSFKLEEAMKDKGSVWDEIVRENQLYPSKYEEVAVWWFVDVIFGMEGVLGCMNKSKEHGFLGFRNSKNSFISWIDKMKGYKIVP

SEQ ID NO: 444 - protein, 391 aa, Gossypium hirsutum
MSWWWAGAIGAAKKKFEEDEAPRSFQSVGLIIGVTGIVGNSLAEILPLSDTPGGPWKVYGVARRPRPNWNADHPIEYIQCDISDPNDTESKLSQLTDVTHIFYVSWINRTSEAENCEINGSMLRNVLHSVIPNAPNLRHICLQTGAKHYLGPFELLGKIQPHDPPFTEDLPRLNAPNFYYHQEDILFEEIEKKEGLTWSVHRPGVIFGFSPYSLMNLVGSLCVYAAICKHEGKPLHFPGSKAAWNCYFEASDADLIAEQHIWAAVDPYAKNEAFNVTNGDVFKWKHLWSVLAEQFGIEEFGFVEGENRGMEEMMKEKEGVWEEIVKENQLQKTSLQVVGNWWFTDTIFLAPLQMPLLSMNKSKEHGFLGFRNSRNSFVTWIDKMKAYKIVP

SEQ ID NO: 445 - protein, 394 aa, Cucumis sativus
MSWWWAGAIGAAKKKFEEDEPPRSFESVALVIGVTGIVGNSLAEILPLSDTPGGPWKVYGVARRPRPAWNADHPIEYIQCDVSDPQDAETKLSQLADVTHLFYVTWTNRTTEIENCEANVKMLRNVLRSVIPNAPNLRHICLQTGTKHYVGSFESIINKSSQRHDPPFTEDLPRLECPNFYYKQEDLLWEEIEQSQKKDLTWAVIRPNLIFGFSPFSLMNVVGTLCVYAAICKHEGRPLKFPGNKLAWEDFQVASDADLIAEQHIWTAVDPYSKNEAFNCNNGDVFKWKHFWKVLAEQFNIEEYGFDEEGESLTLVDLMKDKSDVWDEIVKENQLQQTKLEEIGTWWFVDSIFSMSGNIDSMNKSKEHGFLGFRNSKNSFISWIDKIKAFKIVP

SEQ ID NO: 446 - protein, 399 aa, Citrus clementina
MSWWWAGAIGAAKKKFEENERQPQPQPQDYQHVGLVIGVTGIVGNSLAEILPRQDTPGGPWKVYGVARRPRPDWNADHPIEYIQCDVSDQDDTQAKLSKLTDVTHIFYVTWASRPTEAENCEVNGAMLRNVLRSVIPNAPNLRHVCLQTGGKHYVGPFESFGKIRPHDTPFTEDLPRLNVTNFYYTQEDILFEEVEKRKGPLSLTWSVHRPHIIFGFSPYSMMNVVGTLCVYAAICKHEGVPLLFPGSKDCWEGYSVASDADLIAEQQIWAAVDPYARNEAFNCSNGDVFKWKHLWKVLAEQFEIENYGLPQEGERVRLEEIMRGKEGVWEQIVKENQLQLTKLSEVAVWWFADMMLDGGFLLLDSMNKSKEHGFLGFRNSKNSFVNWIDKMKTYRIVP

SEQ ID NO: 447 - protein, 387 aa, Catharanthus roseus
MSWWWAGAIGAAKKKFEFDDAPPKYQSVGLILGVTGIVGNSLAEILPLSDTPGGPWKVYGVARRPRPSWNADHPIEYIQCDISDPEETESKLSKLTDVTHVFYVTWTNKSTEVENCEANGKMFRNVLNAIIPNCPNLQHICLQTGLKHYFGPFEFFGKAAQETPFHEDLPRLDVPNFYYTLEDILFEEVQKKEGLSWSVHRPGTIFGFSPFSLMNLVGTLCVYAAICKHEGLPLKFPGCKEAWEGYSMCSDADLIAEQQIWAAVDPYAKNEAFNVSNGDVFKWKHFWKVLAEQFGLECAEYEGDKVSLEEMMKDKEAVWEEIVRENGLLPTKLEEVGGFWFVDFIFGVEYPLDSMNKSKEHGFLGFRNSKNAFISWIDKAKAYKIVP

SEQ ID NO: 448 - protein, 389 aa, Fragaria vesca
MSWWWAGAIGAAKKKFGPDDEPPKYQSVALVLGVTGIVGNSLAEILPLPDTPGGPWKVYGVARRPQPQWNADHHIQYIQCDLSDSEQTETELSQLTDVTHIFYVTWASKPSEAENCEANGKMLSNVLNAVIPNAPNLQHICMQTGRKQYVGPFEMFGKIEPHEPPYVEDTSRLDCPNFYYVMEDILFEEVKKKEGLTWSVHRPGIIFGFSPYSLINTIGSLCVYAAICKHEGQPLRFPGSKGTWEGFWDASDADMIAEHEIWAAVEPYAKNEAFNCSNGDVFRWKHLWGILADQFEVESGGVDEELRVEEMMKDKGPVWDEIVRKHDLVPSKLEEVGNWWLVDIIFRIGVDSSMDSMNKSREHGFVGFRNSKTSFLSWIDKMKSYRIVP

SEQ ID NO: 449 - protein, 405 aa, Prunus avium
MSWWWAGAIGAAKKKHEDDDHEAPRSFKSVGLVIGVTGLVGNSLAEILPLHDTPGGPWKVYGVAPRPRPDWSVDHPVEYIQCDISDPIDAQTKLSQLTDVTDIFYVTWTSRSTEADNCEANGALLRNVLSSVIPNAPNLRHVCLQTGTKHYDGPFEAYGKVAPHDTPSTEDLPRLNVPLFYYNLEDVLFEEVEKKEGLTWSVHRPGLIFGFSPYSMLSIVSMLCAYAAICKQEGLALRFPGSKAGWDSYSEASDADLIAEQQIWAAVDPYAKNEAFNINNGDVFKWKQLWKVLAEEWDVFKWKQLWKVLAEEFEIEEYGFDEGFSLVEMMRDKGGVWEEIVGENQLRHTKLEELGLWEVVEVVLGGGAELSSMNKNKEHGFCGFRNSRNSLVYWIDKMKAHKIVP

SEQ ID NO: 450 - protein, 389 aa, Salvia rosmarinus
MSWWWAGAIGAAKKKIDEDEPPPNYQSVALVVGVTGIVGNSLAEILPLSDTPGGPWKVYGVARRPRPSWNEDHPINYISCDVSDPDDVKSKLAPLTDITNIFYVTWTNRSTEEENCEANGKMLKNVLNVVIPNCPNLKHICLLTGRKHYLGPFNSVWKIQVPDPPFTEDLPRLDCPNFYYTQEDILFEEVQKKEGLTWSVHRPGVIFGFSPYSMMNLVGTLCVYAAICKHEGAVLRFPGCKDAWDGYSDCSDADLIAEHQIWAAVDPYAKNEAFNVSNGDVFKWKHFWKVLAEQFGLECGEYEEGKEVKLQELMKEKGPVWDEIVRENGLSCTKLEDVGKWWFSDLILEHAGMLDTMNKSKEHGFLGFRNSKNSFISWIDKLKAYKIVP

SEQ ID NO: 451 - protein, 425 aa, Elaeis guineensis
MSWWWAGAIGAAKKKIDEDSGGGGGGGAPKFQSVGLVIGVTGIVGNSLAEILPLSDTPGGPWKVYGVSRRPLSVSFRPLTEGLAVEHIQCDVSDPDDALAKLSPLTDVTHVFYVAWANRIVEAENREVNSALLRNVLAAVLPNAPNLQHVCLQTGRKHYLGSFESLGKVKAHEPPFREDLPRLDCPNFYYDLEDILFEEMAKRDGTVTWSIHRPTTIFGFSTYSLMNLVGSLCAYAAICRREGAPLKWPGSRVVWEDFSDASDADMIAEHQIWAAIDPYAKNEAFNCSNGDLFKWKHLWPLLAREFGVEWVGYEGEEQRFKLVDAMKEKEGLWEEIVAEHELAPTRLEEVGNWWFVDAVFGVEEVHLDSMNKSKEHGFLGFRNTVVSTIMSHCILHLEPWDPNILTLQVDHRSECIYEREGLTFY

SEQ ID NO: 452 - protein, 391 aa, Erythranthe guttata
MSWWWAGAIGAAKKKIEEDEPPQKHEGVALIVGVTGIVGNSLAEILPHSDTPGGPWKIYGVARRPRPTWNADNPVNYIQCDISDPEDTRVKLSPLTDITHVFYVTWANKSTEAENCEVNGKMLQNLLDAVIPNSPNLKHICLQTGRKHYIGPFESFGKNIPTHDPPYTEDLPRLNHINFYYTLEDILFAEVEKKEGLTWSIHRPGNIFGFSPYSMMNLVGTLCVYAAICKHEGVPMKFPGSKIAWEGYSDCSDADLIAEHQIWAAVDRFAKNEAFNVSNGDVFKWKHFWKALAEHFGVEFVEYEEGGEEVKLEELMKDKGSVWDEIVRENGLTVTKLEEVGTWWFSDLILGGECSLDSMNKSKEHGFLGFRNSKSSFVSWMYKVQACKIVP

SEQ ID NO: 453 - protein, 389 aa, Helianthus annuus
MSWWWAGAIGAAKKKLDDEDAPPKYQSVALIIGVTGIVGNSLAEILPLSDTPGGPWKVYGVARRPQPQWNSDHPIEYIQCDVSDPDETLTKLGCLQDVTHLFYVTWANQATESENCEINGKMFQNVLDAVIPDSPSLQHICLQTGKKHYWGPFELYGKASHDTPYHEDLPRLDVPNFYYTLEDILFESVGRKEGLTWSIHRPGLIFGFSPYSLMNLIGALCVYATICKHEGVPLKFPGTKEAWESYHDCSDADLIAEQHIWAAVEPHAKNEAFNISNGDVFKWKHLWKVLAEQFEVENGGFDEGGERVSLVEMMKDKGGVWDEIVREKGLVSTKLEEVAAWWFADGMLGIEGVLDTMNKSKEHGFFGFRNSKSSLVSWIEKMKGYKIVP

SEQ ID NO: 454 - protein, 390 aa, Genlisea aurea
MSWWWAGAIGAAKKKLDEDDAPPKHQSVALIIGVTGIVGNSLAEILPLSDTPGGPWKVYGVARRPRPPWNEDNPITYIQCDVSDPEDTQAKLSPLSDVTHLFYATWANKSTEAENCEINSRMFQNVLDCIIPSSPSLKHICLVTGRKHYIGPFESFGKIEPHDPPFTEDLPRLDHINFYYDLEDILFEQVKKKEGLTWSVHRPGTIFGFSPHSMMNIVGTLCVYTAICKHEGVPLRFPGVKAAWEGYSDCSDSDLIAEHQIWAAVDPYAKNEAFNVSNGDVFKWKHLWKVLADQFGVENGGFVEEGERATLADLMKDKGPVWDEIVRENGLLPCELKDVGLWWFVDLMLGGEALLDSMNKSKEHGFLGFRNSKNSFASWIDKVRAYKIVP

SEQ ID NO: 455 - protein, 351 aa, Arabidopsis thaliana
MSWWWAGAIGAAKKKLDEDEPSQSFESVALIIGVTGIVGNSLAEILPLSDTRSKLSPLTDVTHVFYVTWTNRESESENCEANGSMLRNVLQAIIPYAPNLRHVCLQTGTKHYLGPFTNVDGPRHDPPFTEDMPRLQIQNFYYTQEDILFEEIKKIETVTWSIHRPNMIFGFSPYSLMNIVGTLCVYAAICKHEGSPLLFPGSKKAWEGFMTASDADLIAEQQIWAAVDPYAKNEAFNCNNADIFKWKHLWKILAEQFGIEEYGFEEGKNLGLVEMMKGKERVWEEMVKENQLQEKKLEEVGVWWFADVILGVEGMIDSMNKSKEYGFLGFRNSNNSFISWIDKYKAFKIVP

SEQ ID NO: 456 - protein, 390 aa, Lupinus angustifolius
MSWWWAGAIGAAKKKLDEEEAPPTSFQNVGLVIGVTGITGNSLAEILPLADTPGGPWKVYGVARRPRPSWNADHPIQYIQCDISDPNDTQSKLSVLTDVTHVFYVAYTNLPTEAESCQVNGDMLRNVLRSVIPNAPNLRHVSLQTGCKHYIGPFELIGKIKSHEPPHTEDLPRLDAPNSYYTQEDILFDETEKIEDLTWSVHRPQIIFGFSPYSSINVIRNLSIYAAICKHERVPLKFPGTKDAWECYAIASDADLIAEQHIWAAVDPYARNEAFNCSNGDLFKWKHMWPVLAEQFGIEDYGFEEGSKLKLSEFMKDKGSVWDEIVKENQLLPMKLEEVSDWWFLDLLFSIESPMDSMNKSKEHGFLGFRNSKNSFITWIDKAKTYKIVP

SEQ ID NO: 457 - protein, 405 aa, Ananas comosus
MSWWWAGAIGAAKKKLDENAEAAAAAVPTRYESVGLVVGATGIVGTSLLEILPLSDTPGGPWKVYAVSRNPRPSWSPPICDGPSVEHVQCDLSDPDDAAAKLSPLADVTHVFYVAWTSRPSEDENRAANTAMLRNALSVLVPAAPNLQHVCLQTGRKHYVGPFEALGRVPAHDPPFHEDLPRLDVPNFYYDLEDALLDELSKRPSSSSPVSWSVHRPSVIFGFSPRSAMNLVETLCVYAALCRREGAKLRWPGGRVAWEGFSDASDADLVAEHQIWAAVDPFAKNEAFNCSDGDVYKWKHLWPILADQFGVDWVGYEGEEKRFKLAEAMEGKEQLWAEMVTEHELTPTRLDEVGNWWFADIMFGYDAEHLDSMNKSKEHGFLGFRNTVSSFNTWIDKMKAYKIVP

SEQ ID NO: 458 - protein, 395 aa, Beta vulgaris
MSWWWAGAIGAAKKKLEDSDDVSTTSINYQSVALIVGVTGIVGNSLAEILPLSDTPGGPWKVYGVARRPRPNWNAEHPIEYIQCDISDKDDVVLKLSPLTDVTNIFYVCWANCVTEAENCKINSMMFQNVLNAVVPNAPNLKHICLQTGMKHYTGAFEYWGKVEHLLDPPYSEDMPRLELPNFYYDLEDILYAQVAKKEDITWSVHRPGCIFGFSPYSVMNVLGTLCVYAAICKHEGIPFRFPGSKIIWESYSQASDADLIAEHQIWAAVDPYAKNEAFNCSNGDVFKWKHLWQVLGEQFGVEVAEFDERVGGFSLAEWIKGKDSVWEEIVKENDLVATKLEEVGTWQFVDMAFSWNWPLDTMNKSKEHGFLGFRNTKNSLIYWVDKMKAYKIVP

SEQ ID NO: 459 - protein, 394 aa, Gossypium raimondii
MSWWWAGAIGAAKKKLEEDETPKSFQSVALVVGVTGIVGNSLAEILPLSDTPGGPWKVYGVARRPRPHWHAEHRIEYIQCDVSDPKDTESKLSQLTDVTHIFYVSWVNRTTETDNCEINGSMLRNVLHTLILNAPNLRHICLQTGAKHYVGSFEYITSGKIEPHDPPFTEDLPRLNTPNFFYVQEDILLQEIEKKQGLTWSVHRPNTIFGFSPYSLMNIVGTLCVYAAICKYEGKPLLFPGNKVTWESYSEVSDADLIAEHQIWAAVDPYAKNEAFNVNNGDIFKWKHLWKVLAEQFGIEKYGLEEGKNVGLKEMMKGKESVWEKIVNEKGLQKTRLEEVGFWWFVDILLSMMPMESPILCMNKSKEHGFLGFRNSKSSLITWIDKMKAFKIVP

SEQ ID NO: 460 - protein, 390 aa, Citrus sinensis
MSWWWAGAIGAAKKKLGEDDERNVGLVIGVTGILGNSLAEILPRPDTPGGPWKVYGVARRPRPHWNADHPIEYIQCDVSDPQQTQTKLSQLTDVTHIFYTTWASSPTEVENCQINGAMLRNVLHSVIPSAPNLRHICLVTGAKHYLGPFEVATRRMKSHPLEPPFTEDLPRLNMPNFYYTQEDILFEEVEKREGLTWSVHRPHLVFGFSPYSLMNVVGTLCVYAALCKHEGIPLLFPGTKDCWEGFSVASDADLIAEQQIWAVVDPRARNEAFNCSNGDVFKWKHLWKVLAERFGIEKYGFEEGGETVRLEEILKGKESVWEEIVKENQLRPTKLNEVAAWWIADVTFDIGAGMLVSMNKSKEYGFLGFRDSNKSFATWIDRLKHYKIVP

SEQ ID NO: 461 - protein, 389 aa, Amborella trichopoda
MSWWWAGAIGAAKKKNDEDEGPVKYQSVALVVGVTGIVGNSLAEILPLSDTPGGPWKVYGVGRRPCPKWSEDHPIEYIQCDILNLEETTAKLSPLTDITHVFYVTWADRISEAENCDVNGHMFRNVLDALLPNAPNLQHICLQTGRKHYLGPFEAIGHVKPHEPPYQEDVPRLPCLNFYHTLEDILFEAAEKKEGLTWSVHRPTVIFGFSPYSLMNLVGSLCVYAAICKHEGLPFRFPGSKAQWEGFSDASDADLIAEQHIWAAVDPHAKNEAFNCANGDVFRWKQLWKILGEQFGLELVEYEGKGFSLVEAMKEKGPVWDTIVKENELSETKLQEVAQWWFADVMLDNEGVGLDSMNKAKEHGFLGFRNTLTSFSSWIDKMKAHKIVP

SEQ ID NO: 462 - protein, 412 aa, Musa acuminata
MSWWWAGAIGAAKKKTTGDDADAPAARYQSVALVVGATGIVGSSLYDILPLADTPGGPWKVYGVSRRPPRPSLLSPNIADGVGLPVVHVPCDVADPADALAKLSPLGDVTHIFYAAWCRRSTAAETRATNAAMLRNVLDAVLPAAPNLQHVCLQTGRNHYLGPYGPAGGVVAEVGPRHDPPHDPPFPENTPRLAIPNFYYELEDVLLEELAKKERAVTWSVHRPTTIFGFSPCSLMNLVCSLCVYASICRKEGVPLRWFGSEEAWYGFSDASDADLVAEHQIWAAVDPYAKNEAFNCSNGDVFKWKHLWPVLAEQFGVPAVGYTGYDGRFKLEDAMKGKEAVWEDIVRENELVPTALDEVGHWWYADAVLGLEFEHLDNMNKSKEHGFLGFRNSVTSFNTWIDKLRAYKVVP

SEQ ID NO: 463 - protein, 356 aa, Zostera marina
MSWWWAGAIGAAKKKVDDDEAETERIPIRYESVGLVIGATGIVGNSLVDILPLPDTPGGPWKVYAVARRPRPTWNLTDHPVEYIQCDVSDVTDVQAKLSPLTDVTHIFYVTRAPGKTEEENCAVNGQMLRNVLDAVIPNSVRLQHISLQTGRNHYVGPPELSDEIEIHDQPYHEELPRLNGPNFYYTQEDILARYEGVPFRFPGGKHAWEGFSDASDADLIAEHQIWASVDPYAKNEAFNCSNGDIFSWKVMWKVLSEQLELECVGYEGEEKRFSLEEAMKGKEGIWEAMVKENGLSETSLSEVGNWQFVDRCLNSEKTHLDSMNKSKEHGFSGFRNSINSLIYWVDKVKTYRIVP

SEQ ID NO: 464 - protein, 389 aa, Cephalotus follicularis
MSWWWAGAIGAAKKKYEEDEQPRSYQSVGLVVGVTGIVGNSLAEILPLSDTPGGPWKVYGVARRPRPDWNADHPVDYIQCDVSDPTETQSKLSTLTDITHIFYVTWASRSTEVENCEVNGAMFRNVLRAVIPNAPNLRHICLQTGGKHYLGPFELFGKIQAHDPPFTEDLPRLDAPNFYYTLEDVLFEEVEQKEDVSWSVHRPGAIWGFSPYSLMNIIGTLCVYAAICKHEGKPMLFPGSKAAWECYSIASDADLIAEQQIWAAVDPYARNEAFNCFNGDVYRWKQFWKVLAEQFEIEEYGFEEGKNVGLVEMMKGKEAVWEEIVKENQLQDTKLKDVGVWWFVDLALGGEGTMLCMNKSKEHGFLGFRNSKNSLINWVDKMKAYKIVP

SEQ ID NO: 465 - protein, 394 aa, Ipomoea nil
MSWWWAGAIGAAKKRFGEEDDAPPKHQSVALILGVTGIVGNSLAEILPLADTPGGPWKVYGVARRPRPAWNADHPIQYIQCDISAEEDAQSKLSVLTDVTHVFYVTWAHRPTELENCEVNRKMLGNVLNAVVPNSPDLKHICLQTGQKHYWGPFELSGKLSHDPPHHEDLPRLDAPNFYYVLEDLLFDEVKKKKEEGLTLTWSVHRPGTIHGFSPYSMMNIVGTLCDYAAICKHEGAPLRFPGIKDSWDGYSICSDADLIAEQEIWAAVDPYAKNEAFNVSNGDVFKWKHLWKILAEQFEVEAGEFEEEGERLTLQEMMKEKGPVWDEIVEKNNLQPTKLEDVGVWWFADVILGICYPLDSMNKSKEHGFLGFRNTHKAFISWIDEMKAHKIVP

SEQ ID NO: 466 - protein, 391 aa, Ricinus communis
MSWWWAGAIGAAKKRVEDDDPQPKYQSVALIIGVTGIVGNSLAEILPLADTPGGPWKVYGVARRPRPIWQADHLIEYIQCDVSNEEQTLEKLSTLKDTTHIFFVAWASEPTEAENCIVNGTMLRNVLRAVIPNAENLQHVCLQTGRKHYVGSFESIWKIPSHESPFHEDLPRLNDINFYYTLEDVLFDETQKKEGLTWSIHRPGVIFGFSPCSLINMVGTLCVYAAICKHQGLPLTFPGNRDAWDGYWDASDADLIAEHQIWAAVDPYAKNEAFNCSNGDVFKWKHLWKELAEQFEIENYGFEEENDKRPSLVEMMKNKGPVWDEIVKEKELLPTRLEEVAAFWLVDLLLQGASLLDSMNKSKEHGFLGFRNSNKSFASWIDKLKAQRIVP

SEQ ID NO: 467 - protein, 400 aa, Elaeis guineensis; identical to SEQ ID NO: 382

SEQ ID NO: 468 - protein, 400 aa, Citrus clementina; identical to SEQ ID NO: 383

SEQ ID NO: 469 - protein, 410 aa, Musa acuminata
MSWWWAGAIGAARKKLEDDSSSTVPKYESVAIVIGATGIVGTSLVDILPLADTPGGPWKVYAVSRRPPNSAILPYSYSPADAEAPVAADTLRVQHIQCDVLDAADAVAKLSPLTDVTHLFYVAWANRLTEAENRVVNSAMLRNVLSAVVPSAPNLCHVCLQTGRKHYVGPFEAVGKALAHDPPFREDLPRLPVPNFYYDQEDILFDELSKKEGAVTWSIHRPTTIFGFSPTSLMNLIGTLCVYAAICRKEGAPLKWFGSRTTWDGFNDASDADLIAEQQIWAAVDPYAKNEAFNISNGDLFKWKHLWAALADQFGLESVGYEGEASRFKLEDAMRGKEAVWAEIVAENELVPTKLEEVASWWFADVVLGLELAHLDSMNKSKEHGFLGFRNTVASFNSCIDKMKAFKIVP

SEQ ID NO: 470 - protein, 390 aa, Theobroma cacao
MSWWWAGAIGAARKKLEEHDEPSKYKSVALVIGITGIVGSSLAEILPFSDIPGGPWKVYGVARRPRPAWTNALPIDYIQCNISNEEETQEKLSKLKDVTHIFYVAWAKKSSEAENCMVNGTMLRNVLKAVIPNAPKLKHVCLQTGRRHYTGPFDSVGKVQPHDPPFREDLPRLPVLNFCYTLEDVLFEEVKKKDGLTWSVHRPGVIFGFSPCSLMNIVGSLCVYAAICKHEGKPLRFPGSRQAWDGYWDASDADLIAEHQIWAALNRHAKNEAFNCSNGDVFKWKDLWKVLAKQFGIEDYGFHESDERHSLVEMMKDKGPLWDEIVREKGLVPTKLNEVGAWRFADAVLSGKSLLDSMNKSKEHGFVGFRNSKTSFNSWIDKMKTHKIVP

SEQ ID NO: 471 - protein, 388 aa, Gomphocarpus fruticosus
MSWWWAGAIGAARQKKTDDYTALTKFQSVGLIIGVTGIVGNSLAEILPLSDTPGGPWKVYGVARRPRPAWNADHPIEYVQCDIANREDTEEKLSKLTDVTHVFYVTWANKSNEIENCEVNGKMLKNVLDVLVPNCPKLQHVCLQTGGKHYCGPFELYGKVGHEPPFTEDLPRLDVPNFYYTLEDVLFEAVGKKEGLTWSVHRPGNIFGFSPYSLMNLVGTLCVYAAICKHDGVPLKFPGCKEAWEGYSVCSDADLIAEHQIWAAVDPFAKNEAFNVSNGDVFKWKHFWKVLAEQFDVECGEYEGEKLSLEDMMKDKGGVWDEIVAENGLAPTKLEEVGLWWFGDICLGYECALMSMNKSKEHGFLGFRNSKNAFISWIEKMKAYKIVP

SEQ ID NO: 472 - protein, 391 aa, Lupinus angustifolius
MSWWWAGAIGANKKKSNEEEEEPPTSFNNVGLVIGVTGIVGNSLAEILPLADTPGAPWKLYGVARRPRPPWNSGHSINYIQCDISDPDDAQSKLSVLTDVTHIFYVSWSQQPTEAENCNVNGAMLRNVLTSVIPNAPNLRHVSLQTGAKHYLGPFELFGEINPHDPPFTEDLPRLEVPNFYYTQEDILFEEVNKKENLTYSIHRPHFIFGFSPYSFMNLIGTLCVYAAICKHEGLPLKFPGTKEAWECYSTASDADLIAEQHIWAAVDPNARNEAFNCSNGDVYKWKNLWEVLAEQFEIEEYGFEEGCDLRLEELMKDKGHVWDEIVKENELLPTKLEEIGEWWFSDLMLGMEPVLDSMNKSKEHGFLGFRNSKNSFITWIDKNKAYKIVP

SEQ ID NO: 473 - protein, 374 aa, Brachypodium distachyon
MSWWWAGAIGAVKKRQDESAAAAEPSFQSVALVVGSTGIVGTSLLDILPLQDTPGGPWKVYALSRRPLPPWSPPPSPAVTHLHLDLADSAAVADALTPLTDITHVFYVAWSNHPTEAQNREANSAMLRNVLSVVVPNCPALVHVCLQTGRKHYIGPFEAIGKIPAPDPPYTEDMPRLDYPNFYYDQEDVLFDEVSRRGGAVSCLCVYAAICRKEGATMRWPGSKVAWEGFSDSSDADLIAEHEIWAAVDPFAKNEAFNCSNGDLYKWKQLWPMLADHFEVEWAGYDGEENRFMLTQAMAGKEAVWAEILQENELIRTELEEITNWWFVDALFNVETQHLDSMNKSKEHGFLGFRNTTNSFNTWIEKMKVFKIVP

SEQ ID NO: 474 - protein, 396 aa, Oryza brachyantha
MSWWWAGAIGAVKKRQEENAAATEPSFQSVALVLGSTGLVGTSLLDILPLQDTPGGPWKVYAVSRRPLPPWSPPDSPAVTNLHLDLADPAAVAEALTPLTDITHVFYVAWSPQPTEAQNLEVNAAMLRNVLSVVVPNCPALVHVCLQTGRKHYIGPFEAIGKIPVPDPPFAEDMPRLNCPNFYYDQEDVLFEEVSRRDGAVSWSVHRPTTIFGFSPRSAMNVVGSLCVYAAICRKEGAVLRWPGTRVAWEGFSDASDADLIAEHEIWAAVEPFAKNEAFNCSNGDLYKWKLLWPMLADQFGVEWSGYEGEESSFKLEDAMSGKEAVWAEIVMENGLVETELKEITNWWFVDAVFGVQSEHLDSMNKSKEHGFLGFRNTVNSFNTWIEKMKVFKIVP

SEQ ID NO: 475 - protein, 389 aa, Catharanthus roseus
MSWWWAGAIGVAKRKLDDFDAPPKYQSVGLILGVTGIVGNSLAEILPLSDTPGGPWKVYGVARRPRPSWNADHPVEYIQCDISDPEDAQSMLSKLTDVTHVFYVTWASKSTEVENCEVNSKMFRNVLNAIIPNCPNLQHICLQTGLKHYLGPFELFGKAAVAHEPPFHEELPRLDVPNFYYTLEDILFEEVQKKEGLTWSVHRPGNIFGFSPFSLMNLVGTLCAYAAICKHEGVPLRFPGCKEAWQGYSMCSDADLIAEHQIWAAVDPYAKNEAFNVSNGDVFKWKHFWKVLAEQFGAEYAEYQGERLSLQELMKDKGPVWENIVRENGLVPSKLEEVGVWWFADLVLSVECPLDSMNKSKEHGFLGFRNSKNAFISWIDKAKAYKIFP

SEQ ID NO: 476 - protein, 390 aa, Populus euphratica
MSWWWAGALGAARKQSENGDTSRGHQSVALVVGVTGIVGNSLAEILPLSDTPGGPWKVYGVARRPRPNWNLDHPVEYIQCDISDTAETQAKLSQLTDVTHIFYVTWALRFTEAENIQANNLMFRNVLQAVIPNAPNLKHVCLQTGLKHYVGPFELVGKIEPHDTPYTEDLPRLNAPNFYYDLEDILAEEVATKEGVTWSVHRPHTIFGFSPYSLMNMMGTLSVYAAICKHEGMPLLFPGTESVWNAYSIASDADLIAEQEIWAAVDPNAQNEAFNIHNGDVFKWKHLWKVLAEQFGIEKYGLPESGKKVSLTELMKDKGAVWEKIVKDNQLLPNKLEEVGVWWFADFVLGAESIISCMNKSKEHGFLGFRNSKNSLISWVDKLKAHKIVP

SEQ ID NO: 477 - protein, 390 aa, Catharanthus roseus
MSWWWAGAVAAARKRFNEDEAPKNFQSVALIVGVTGIVGNSLAEILPLSDTPGGPWKVYGVARRPRPAWNADHPVEYIQCDVYNSDETQAKISPLTDVTHIFWTTWANRPTEAQCCEVNGTMFQNVVNALLPNAPNLSHICIQTGHKHYIGPFEAFGKVKPHDTPFIEDVPRLDAPNFYYTLEDIAFDACNKKEGLTWSVHRPAVIFGFSPLSMMNLVGTLCVYAAICKHENVPLTFPGTKAAWNCYSVASDADLIAEHQIWAAVDPYAKNEAFNCSNGDIFKWKHLWKVLAEQFEVDYVEFDENQEFVSLSDRMKDKGSVWDEIVEKNQLIPTKLEEVATFWFADLILGFECMLDSMNKSKEHGFLGFRNTAKSLVSVVDKMKAHKIVP

SEQ ID NO: 478 - protein, 391 aa, Prunus mume
MSWWWAGAVGAAKKKFDEDEAPRSPESVGLVIGVTGIVGNSLAEILPISDTPGGPWKVYGVARRPRPNWNADHPVEYIQCDISDADDAKAKLSPLSDVTHIFYVTWTNRSTEAESCEANGAMFRNVLNSVIPNAPNLRHVCLQTGAKHYVGPFEAFGKIQPHESPFTEDLPRLDYPNFYYTLEDLLFAEVEKKDDLTWSVHRPDAIFGFSPYSMMNIVGTLCVYAAICKHERVPLKFPGSKAAWNCYSVASDADLIAEQHIWAAVDPYAKNEAFNINNGDVFKWKHVWKVLAEQFGIEEYGIDEEEGAKLSLVELMKGKERVWEEIVKENQLQPTRLEEVGVWWFVDVWLGGEGLLCSMNKSKEHGFVGFRNSRNSFVTWIDKMKAFKIVP

SEQ ID NO: 479 - protein, 395 aa, Ziziphus jujuba
MSWWWAGAVGAAKKKFGEDEAPTSFQSVGLVVGVTGIVGNSLAEILPLADTPGGPWKVYGVARRPRPAWNADHPIEYIQCDISDPQQTQAKLSSLTDVTHIFYVTWTNRISEAENCAANGAMFRNVLSAVIPNAPNLRHICLLTGGKHYLAPFESIGKIQAHDPPFHEDIPRLDAPNFYYTLEDILFEESEKKEGGGLTWSVHRPNVIFGFSPLSLMNLIGSLCVYAAICKHLGLPLKFPGTKSAWDGFSMVSDADLIAEHQIWAAVDPYARNEAFNINNGDVFKWKHLWKELAEQFGIEDYGFDDDGDDGKRLKLVELMKDKGPVWEEIVKVNQLEPTKFEEVGVWWFADMMLSEAGALASMNKSKEHGFLGFRNSRNSFVYWIDKLKSYKIVP

SEQ ID NO: 480 - protein, 395 aa, Prunus persica
MSWWWAGAVGAAKKKLEGADTTAPEGYQSVALVIGLTGIVGNSLAEILPLHDTPGGPWKVYGVARRARPDWSVDHPVDYIQCDISDPEDTQAKLSELTDVTHIFYVTWTSRANEIENCEANGAMFRNLLRVVIPVAPNLRHVSLQTGTKHYLGPFECIGKIKAHDPPFTEDLPRLDVPNFYYTLEDILFEEVQKKEGLTWSVHRPYNIFGFSPHSLMNIIGTLCVYAAICKKEGKPLKFPGSKVAWECYAMASDADLIAEQHIWAAVDPNAANEAFNINNGDVFKWKQFWKGLAEQFGIEEHGFYEEEEGEGRLSLVEMMKGKEGVWEEIVKENELQPTKLEEVGVWWFADYVLGGEAVLDSMNKSKEHGFLGFRNSYKSFISWIEKMKSYKIVP

SEQ ID NO: 481 - protein, 391 aa, Sesamum indicum; identical to SEQ ID NO: 384

SEQ ID NO: 482 - protein, 395 aa, Panicum hallii
MSWWWAGAVGAAWKRRGDRAASSESFQFQSVALVVGSTGIVGTSLVDILPLPDTPGGPWKVYALSRRPPPPWFQPPSPSVTHIQVDLTDYSAAAEALAPLTDITHVFYVALSWRPTEAQSRETNSAMLRNVLSVVVSSCPRLAHVSLQTGTKHYFGRLGSKTRVHDPPYTEDMPRLDIPVFYYDQEDILFDTVARRAGWSVHRPNLIFGFSPRSEANVVCSLCVYAAICHKEGVKLRWPGSRAAWEGFNNGSDADLIAEQHIWAAVDPMAKNEAFNCSNGDVYRWKLLWPVLAGRFGLEWAGYEGEENRFQVAEAMAGKEAVWAAIVTENELVETEVNEVASWWVIDAVADQFGLDLEILDSMNKSKEHGFLDFRDTVKSFNTWIDRLKAQKIVP

SEQ ID NO: 483 - protein, 391 aa, Fragaria vesca
MSWWWAGAVGAHKKRLDGEDAGPRTPVSVGLVIGVTGIVGNSLAEILPLPDTPGGPWKVYGVARRPRPNWNADHPVDYVQCDVSKPNDVKAKLAPLTDVTHIFYVTWTSKATESENCEANAAMLRNVLNAMIPNAPNLKHICLQTGGNHYLGPFDTWGKIQPHDSPFKEDMPRLNVQNFYYTMEDLMFKEVEKKEGMSWSVHRPDTILWFSPHSMINILASLCVYAAICKHEGMPLRFPGTKGAWNCLSTASDADLIAEQQIWAAVDPYARNQAFNINNGDVFKWKHLWKVLAENFGIEECGFQEKGERVSLREMMKGKSGVWNEIVKKHQLVPTKLEQVGVWWFVDAIFSGECMFGCMNKSKEHGFVGFRNSRNSLVTWIDKMKAYKIVP

SEQ ID NO: 484 - protein, 365 aa, Setaria italica
MSWWWAGAVGTVRKRQDDLAAVSQSEQAFESVALVVGSTGIVGASLVDILLLPDTPGGPWKVLTPLIDITHVFYVAWTWRATEEENCEANSAMLRNVLSVVVPNCPALVHVSLQTGTRHYFGRLDSENCVHYPPYTEDMPRLDMPVFYYDQEDVLIDAVARRGGGAVSWSVHRPNIIFGFSPRCAINLVCSLCVYAAVCCKEGTPLRWPGSRGGWEGFITPSDADLVAEHHIWAGFDPMAKNEAFNCSNGDVCTWKKLWPILAGRFGLEWVGYEGEEKRLKLAEAMAGKEALWAEIVEENELVATHVSEVANWWVVDKSLDRYGLEWDILDSMNKSKEHGFLGFRNTFRSFNTCIDRLKAHKIVP

SEQ ID NO: 485 - protein, 388 aa, Populus trichocarpa
MSWWWAGDLSAAWKKPAVQGGQGSVALIVGVTGIVGNSLAEILPRSDTPGGPWKVYGVARRPRPNWHENCPVEYIQCDISDSALAKSKLSHLTDVTHIFYVTWASRSNEAENCKINGLMFRNLLQAVVPIATNLRHVSLQTGTKHYIGPFESFYNFESHDPPYSEDLPRLKVDNFYYTLEDVMFEEVAKKEGVTWSVHRPDIIFGFSPHSLMNIIVTLSVYAAICKHEGAPLMFPGTKEAWNCYAIASDADLVAEQEIWACVEPNAQNQAFNIHNADYFKWKHLWKVLAEQFGIEKYGFEEGGKRATLAERMKDKGPVWEEIVKKNQLFPTKLEEVGGWWYVDTMLSGDAFISCMNKSKEHGFLGFRNSTKSFVHWIGKMRSQKVIPN

SEQ ID NO: 486 - protein, 390 aa, Juglans regia
MSWWWARAIGAAKKKLEEDEQPRSFQSVGLVIGVTGIVGNSLAEILPLCDTPGGPWKVYGVARRPRPDWNADHPIEYIQCDVSDPEDTQAKLSPLTDVTHIFYVTWTTRPTEAENCEANKAMFRNVLLTVIPNAPSLRHVCLQTGTKQYLGPFESFRKFQTHDPPFTEDLPRLDAPNFYYTLEDVLFEEADKKEGLTWSVHRPNSIFGFSPYSLANIIGMFCVYAAICKHERVPLKFPGTKAAWDGYWVSSDADLIAEQQIWASVDPNARNEAFNCNNGDVFRWKHLWKVLAEQFGIDDYGLDEGEKVVSLVEMMKDKDAVWEEIIRENQLRPRKLEEVGMWVLVDLLFGGESPVDCMNKSKEHGFLGFRNSKNSFISWIDKLKSYKIVP

SEQ ID NO: 487 - protein, 390 aa, Jatropha curcas
MSWWWARAIGTASKKIEEDDRPPKFKSVALIIGVTGIVGNSLAEILPLADTPGGPWKVYGVARRPQPIWQAGHLTEHIQCDISNEEETFEKLSHLKDVTHIFYVTWASKPTEAENCKINGSMLQNVLKTVIPNAKNLQHICLQTGQKHYLGSFESIGKIVPHESPFHEDLPRLKAINFYYTLEDVLFDEVSKREGLTWSIHRPAAIFGVSPCSLMNVVGTFCVYATICKHKGLPLTFPGNQLAWDGYWYASDADLIAEHQIWAAVDPNAKNEAFNCSNGDVFKWKHLWKVLAEKFEIDNYGFEAGDKKLSLVERMKDMGPVWDEIVREKELVPTRLEEVGAWWLIDLFFQGAAYLDTMNKSKEHGFVGFRNSKTCFASWIDKMKSHRIVP

SEQ ID NO: 488 - protein, 392 aa, Hevea brasiliensis
MSWWWARAVEATKKTFEQDDVPPKYQSVALIIGVTGIVGSSLAEILPFADTPGGPWKVYGVARRPRPIWQANHLIEHIQCDISNEQETHEKLSILTDVTHIFYVTWARKSTEAENCLVNGSMLQNVLNAVILNARNLQHICLLTGRKHYMGSFESIGNIAPNEYPLHEDLPRLNVINFYYTLEDLLFDQVRKKEGLTWSIHRPGMIFGFSPFSLMNTLGTLCVYAAICKHQGLPLIFPGNHVAWDGYCDASDADLIAEHQIWAAVDPNAKNEAFNCSNGDVFKWKHLWNVLAEQFEIENYGIEEDGDKRLSLAEMMKDMGPIWDEIVKEKQLFPTRLEEVATWWLLDVVFQLEVSHLDTMNKSKEHGFVGFRNSKKSLVHWIDKIKAYKIVP

SEQ ID NO: 489 - protein, 389 aa, Camptotheca acuminata; identical to SEQ ID NO: 385

SEQ ID NO: 490 - protein, 392 aa, Malus domestica
MSWWWASAVEAAKKKHQEDRYEPPSIPKSVGLVIGITGIVGNSLAEILPLSDTPGGPWKVYGVARRPRPHWNADHAVDYIQCDISDPDDTQKKLSKLSDVTHIFYVTWTNRSTENENCEANAAMLRNVLRIVISNAPNLRHVCLQTGTKQYIGPFETFGKIDHHDPPCSEDLPRLNAPNFYYALEDVLLEEVGKKEDITWSVHRPGVIFGFSPYSLANMVAMLSVYAAICKHEGMPLKFPGSKEAWNCYSDASDADLIAEQQIWAAVDPYAKNKAFNVNNGDVFKWKQLWKVLAEQFEIEEYGFDEEGEKLSLAELMKVKEGVWEQIVKENQLEPMKLVEIGQWWLVDLVFGGEGLMTSMNKSKEHGFLGFRNSGNSFVSWIDKLKAFKIVP

SEQ ID NO: 491 - protein, 376 aa, Panicum hallii
MSWWWERAVGEVSKRRGDRAAASHRSFQVQSVALVVGSTGVVGASLVDILPQPDTPGGPWKVYALSPRPPPPWYPSRSPSSVTHVHVDLTDSPAVAEAHAPLTDITHVFYVAWSSRPTDAQNREANAAMLRNVLSAVVPTCPALAHVCLQTGTKHYVGSFEAIGRVPLPEPPYTEDMPRLDCPDFYYDQEDILVDAVSRRGGVSWSVHRPRLILGFAPRSAMNVVCSLCVYAAICRSEDVRAVVRWPGTRGAWEGFDNASDADLVSEQQIWAAVDPMAKNEAFNCSNGTAGMEDVRAVIAKENELVETQLNEVASWWLVEAQFCQFGANRAFLDSINKSKEHGFLGFRNTVKSFNTWIDEMKLHKIVPRCLFMMFI

SEQ ID NO: 492 - protein, 391 aa, Arachis duranensis
MSWWWERSTGAAAKNISNEIDESSQNLQNVALIIGVTGIVGNSLAEILSLQNTPGGPWKVYGVARRNRPAWNTNHPVHYVQCDISNPNDVALKLSPLTDVTHIFYVSWTSKSTEAQNIEVNGSMFRNVLNALISNAPNLRHVSLQTGVKHYVGPFELFGKIKANEPPFTEDLPRVNAPNFYYTQEDILFEMAQKKEGLTWFINRPQVIFGFSPYSLMNLIGTLCVYAAICKHEGVLLRFPGTKAAWECYSAASDANLIADQHVWGAVDARARNEAFNVSNGDVFRWKHLWKVLAEKFGIEEYGFVEGSSLRLSDLMKDKGGVWDEIVKKNNLQATKLEDVGDWWFADIILGMEAVLDNMNKAKEHGFLGFRDSKKSFINWIERTKAYKIVP

SEQ ID NO: 493 - protein, 388 aa, Catharanthus roseus; identical to SEQ ID NO: 373

SEQ ID NO: 494 - protein, 395 aa, Spinacia oleracea
MSWWWLGAIGSSLHKIESGDIPSKYHNVALVVGVTGISGNSLADILQLSTIPGGRWKVYGVGRRRQPEWQFHHNHVQYIQCNMVDPEDCQAKLSHLSDVTHIFYVGWVTKPTEQESSDENGKMLRNVLNAVIPNAPNLKHICLQTGQKYALPCLDSSAEIQHEPQFVEEFPREDITDSYYAMEDILDEEVQKKEKLTWSVHRPAVMFGFSPYSTRNIVGSLCVYATICKHEGQPLRFPGNQAAWDGYSEAGDADLVAEQQIWASLDNKGKKQAFNCSNGDLFKWKDLWKVLAEEFEVKFLEFEEESNSLEEMMREKGPVWDEIVQEKDLLPTKLEEVGTWWYVDSILRSSEAVLDSNNISRGMEKSRNYGFGGSRETAESFRFWIEHTRRYKIIP

SEQ ID NO: 495 - protein, 278 aa, Trifolium subterraneum
MSWWWSGAIGAAKKKFDEDEAPRSFQSVGLVIGVTGIVGNSLAEILPLPDTPGGRWKVYGVARRPRPSWNADHPIEYIQCDITDPNDTQTKLSVLTDVTHIFYVSWTNRPTEAENCEVNGAMLRNVLRAVIPNAPNLRHVSLQTGGKHYLGPFDLIGKIKSHEPPFTEDLPRLDAPNFYYTQEDILFEETKKKEGLSWSVHRPQVIFGFSPYSLMNIVGTLCVYATICKHEGVPLRFPGEGTVDIMNKAKEHGFVGFRNTKNSLIYWIDKTKGYKIVL

SEQ ID NO: 496 - protein, 390 aa, Ziziphus jujuba
MSWWWSGAIGAAKKKFDEIETPISYQSVGLVIGVTGIVGNSLAEILPLSDTPGGPWKVYGVARRPRPDWNADHPVEYIQCDIADADDINKKLSDLTDVTHLFYVTWANRSTEEENCEVNGTMFRNVLRAVIPNAPKLRHICLQTGTKHYTGPFESRGKQEHHDPPLTEDLPRLSGPNFYYTLEDVLYEETEDKPNLTWSVHRPNTIFGFSPFSLMNIIGTLCVYAAVCKHEGVPLKFPGKKAAWDSYSVASDADLVAEQQIWAAVDPYARNEAFNCNNGDVFKWKHLWKVLAEQFGIENYGIEEGDSLSLVDWAKGKENVWEEIVRENQLQPTKLEELGVWWFADLILGEEALLDSMNKSKEHGFMGFRNSRNSFISWVDKFKAYKIVPN

SEQ ID NO: 497 - protein, 389 aa, Medicago truncatula
MSWWWSGAIGAAKKKLDEDEAPQSFQNVALVVGVTGIVGNSLAEILPLADTPGGRWKVYGVARRPRPSWNADHPIEYIQRDITNSNDTQTKFSILTDVTHIFYVSWTSRPTEEDNCEVNGVMLLNVLRAVIPNAPNLCHVSLQTGGKHYLGPFALIDKINSHEPSFTEDLPRLDIPNFYYTQEDILFEETKKKEGLSWSVHRPLLIFGFSPYSLMNVVGTLCLYAAICKHEHISLKFPGTKRAWESYYMASDADLIAEQHIWAAVDTYAKNEAFNCSNGDVFRWKQLWKVLTEQFEIEEYGYEDGPRLRLAEMMKDKGPVWDEIVKENELQPTKLEEVAEWWVADATFGMEDIVDSMNKAKEHGFLGFRNSKNSLINWIDKTRAYKIVP

SEQ ID NO: 498 - protein, 390 aa, Medicago truncatula
MSWWWSGAIGAAKKKLDEDEAPRSFQNVALVVGVTGIVGNSLAEILPLADTPGGRWKVYGVARRPRPSWNADHPVEYIQCDITDPNDATTKLSVLTDVTHVFYVCWASRPTEAENCEINGTMLKNALTAVIPNAPNLRHVSIQTGGKHYVGPFESFGKIKYHEPPYTEDMPRLDYHNFYYTLEDVLFEETGKKEGVSWSVHRPLLIFGFSPYSMMNIIGTICVYAAICKHEGVPLRFPGTKLAWENYYMASDADLIAEQHIWAAVDPYAKNEAFNCSNGDVFRWKQLWKVIAEQFGIEEYGFDEEGPRLKLTELMKDKGPVWDEIVKENGLQVTKLEEVAEWWFADACFGGNGFTDSMNKSKEHGFLGFRNTKNSLINWIDRTRAYKIVP

SEQ ID NO: 499 - protein, 390 aa, Medicago truncatula
MSWWWSGAIGAAKKKLDEDEAPRSFQNVALVVGVTGIVGNSLAEILPLADTPGGRWKVYGVARRSRPSWNADHPVEYIQCDITDPNDATTKLSVLTDVTHVFYVCWASRPTEAENCEINGAMLKNVLTAVIPNAPNLRHVSIQTGGKHYVGPFESFGKIKYHEPPYTEDMPRLDYHNFYYTLEDVLFEETGKKEGVSWSVHRPLLIFGFSPYSMMNIIGTICVYAAICKHEGVPLRFPGTKLAWENYYMASDADLIAEQHIWAAVDPYAKNEAFNCSNGDVFRWKQLWKVIAEQFGIEEYGFDEEGPRLKLTELMKDKGPVWDEIVKENGLQVTKLEEVAEWWFADACFGGNGFTDSMNKSKEHGFLGFRNTKNSLINWIDRTRAYKIVP

SEQ ID NO: 500 - protein, 398 aa, Spinacia oleracea
MSWWWSGAIGAAKKKLEDSDEGSSSSSRNYQSVALIVGVTGIVGNSLAEILPLSDTPGGPWKIYGVARRPRPDWNSDHPIEYIQCDISDENDAVSKLSPLTDITNIFYVCWGNRDSEAENRELNSKMFRNVLNSTIPNSPNLKHICLQTGMKHYIGPFESWGKKIDHQHHDPPFNEDMPRLDIPNFYYDLEDILFAEIAKKESLTWSVHRPGSIFGFSPYSLMNVVGSLCVYAAICKHEGVPLQFPGTKASWESYSQASDADLIAEHQIWTSVDPYAKNEAFNCSNGDVFKWKQLWRVLGEQFEVEIADFDEDGERFSIEERMKGKEGVWEEIIRENGLVATKLEEVGSWWFLDKAFDGEWHLDTMNKSKEHGFLGFRNTKNSFVSWIDKMKAYKIVP

SEQ ID NO: 501 - protein, 389 aa, Juglans regia
MSWWWSGAIGAAKKKSDNRDSPPRYQSVALIIGVTGIIGNSLAEILPHSDTPGGPWKVYGVARRPRPAWSADYPIEYIQCDILDAQEAQTKLSKLTDVTHIFYVAWANMQDEADNCKVNADMLRNVLNTIIPKAPNLQHICLQTGRKHYVVAPELFEIVKPHEPPFHEDLPRLNVPHFYYSLEDVLFEQVAKEELLTWSVHRPGVIFGFSPRSLTNIVGSLCVYAAICKHEGEQLRFPGSLAAWEGYWDASDADMVAEHQIWAAVDSNAKNESFNCSNGDLFKWKHFWKVLAERFGVECGKFDENSNLSLQEMMKNKGPVWEEIVREKGLMPTKLEQVGTWWFVDEVLGAESFLDSMNKSKEYGFVGFRNSKTSFNYWIDKMRAHRIVP

SEQ ID NO: 502 - protein, 391 aa, Populus tremuloides
MSWWWSGAIGAAKKKTEDDEASRGYPSVALILGVTGIVGNSLAEILPLSDTPGGPWKVYGVARRPRPNWNEDHPVEYIQCDISNTAETQSKLSKLTDVTHVFYVTWASKSTEEENCEINGLMFRNVLQAVIPNAANLRHVCLQTGGKQYVGPFALLGKIEAHDPPFTEDLPRLNDFPNFYYTLEDVMYEEVAKKEGVTWSVHRPDIIFGFSPHSLMNLIVTISVYAAICKHEGAPLIFPGTKEAWNGYAIASDANLIAEHEIWACVEPKAKNEAFNINNGDLFKWKHMWTVLAQEFGIEKYGFVEGESSVTFAEKMKDKGPVWEEIVKKNQLLSNKLEQVGGWWFGDLIFSGSGYVASMNKAKEHGFLGFRNSKKSFVSWIHKMRAYKVVP

SEQ ID NO: 503 - protein, 341 aa, Vitis vinifera
MSWWWSGAIGAAKRKLQEDEAHPTNYQGVGLIVGVTGIVGNSLAEILPLRDTPGGPWKVYGVARRPQPAWNADNCVEYIQCDVFDPEETSSKLSKLTDVTHIFYVTWANMGSEAENCRHICLQTGRKHYIGPFEALGKIEPHDPPYHEEMPRLDVENFYHVQEDILFEEVRKKEGLTWSVHRPGVIFGFSPYSMMNAIGTLCVYATICKHEGLPLRFPGTQDTWNGYWDVSDADLIAEHHIWAAVDPFAKNEAFNCSNGDVFKWKHLWKVLAEQFGLEEKGLVPTKLEEVGQWWFADVVLSAGSSLDSMNKSKEHGFLGFRNSKSSFLSWIDKMKAYKFVP

SEQ ID NO: 504 - protein, 389 aa, Vitis vinifera
MSWWWSGAIGAAKRKLQEDEAHPTNYQGVGLIVGVTGIVGNSLAEILPLRDTPGGPWKVYGVARRPQPAWNADNCVEYIQCDVFDPEETSSKLSKLTDVTHIFYVTWANMGSEAENCRVNGDMFRNVLSAVIPNAPNLQHICLQTGRKHYIGPFEALGKIEPHDPPYHEEMPRLDVENFYHVQEDILFEEVRKKEGLTWSVHRPGVIFGFSPYSMMNAIGTLCVYATICKHEGLPLRFPGTQDTWNGYWDVSDADLIAEHHIWAAVDPFAKNEAFNCSNGDVFKWKHLWKVLAEQFGLEFHEPEGQGLSLEKMMKDKGPVWDEIVREKGLVPTKLEEVGQWWFADVVLSAGSSLDSMNKSKEHGFLGFRNSKSSFLSWIDKMKAYKFVP

SEQ ID NO: 505 - protein, 387 aa, Daucus carota
MSWWWSGAIGAARKKLEETEAPPKYESVALVIGVTGIVGNSLAEILPLSDTPGGPWKVYGVARRPRPSWNADHPIEYIQCDISNTDEAQSKLSQLTDVTHIFYVTWSSKPSEAENCKSNGHMFRNVLNAVIPNAINLKHVCLQTGRKHYLGPFELYGKVAHDPPYSEDLPRLNVENFYYTLEDILFEEVEKKEGLTWSVHRPGNIFGFSPYSMMNLIGTLCVYATICKHEGVPMRFPGAKAAWEGYSDASDADLIAEHQIWASVDPYAKDEAFNCSNGDVFKWKHLWKVFEEQFEVKCADFEGEGLCLVDLMKDKGPVWDEIVKVNGLTPTKLEDVAIWWFVDMVLGIECPLDTMNKSKEHGFLGFRNSKSSLITWIDRMKGYKIVP

SEQ ID NO: 506 - protein, 399 aa, Dendrobium catenatum
MSWWWSGAIGAVKKKLDDDFNAAAGKYPSVGLVIGATGIVGMSLVEILPLPDTPGGPWKVYAVSRRPRSSLLPPPSDGFAVETVLCDISDPADARALTKLSPLTDVTHLFYVAWANRESETENIAANTAMLRNVLDVVVPSAPNLQHVCLQTGRKHYIGSFDSLGKVKPHDPPFHEDLPRLPAPNFYYTQEDILFDSLRSRDGAVTWSVHRPTAIFGFAPTSLMNIVGTLCVYATICKREGEPLRWPGSRIAWEGFSDASDADLIAEQHIWAAVDPYAKNEAFNCSNGDVFKWKHLWTTLAEQFELEAVGYIGEVERFKLEAAMKGKEELWEKIVQENHLVPTNLEEVGNWWFVDIMLNNEEHLDTMNKSKEHGFLGFRNTRNSLISWIDKMKGYKIVP

SEQ ID NO: 507 - protein, 389 aa, Passiflora incarnata
MSWWWSGAIGAVRNSEQNDGPRSFESVALVVGVTGIVGNSLAEILPLADTPGGPWKVYGVARRPQPDWNADHPVEYIQCDIADSNDVQTKLSKLVDVTHIFYVTWANRSSEAENCRVNSLMLRNLLEALIPNAPNLRHICLQTGTKHYVGPFELVLQLETHDPPFTEDTPRLNAPNFYYTLEDILLEESKKKEGLTWSIHRPDIIFGFSPYSLMNIIGSLCIYAAICKHEGQPLLFPGTKESWENYAVASDADLIAEQEIWACVDPNAHNEVFNCHNGDLFKWKHLWKVLAEQFEIEKYGFEEREKRVTLEERMKDKGPVWDGIVQKHQLSSTKLEEIGAFWFPDIILGGWSNISCMNKCKEHGFFGFRNSKNSFISWIDKMKAYKIVP

SEQ ID NO: 508 - protein, 394 aa, Prunus avium
MSWWWSGAVGAAKKKFDPNNAPTKYESVALVAGITGIVGNSLAEILPLPDTPGGPWKVYGVARRPRPDWNVDHPVEYIRCDLSDPHQTHSELSQLTDVTHIFYVTWASKPTEVESCEANGNMFRNLLDAVIPNAPNLQHICLQTGRKHYIGPFEKWGKVEPHEPPFDGDLPRLNVPCFYYTLEDILFEEVKKKEGLTWSVHRPSVIFGFSPYSLMNIVGTFCVYAAICKHEGKKKLKYPGSKGFWNGYWDASDADLIAEHEIWAAVDPYAKNEAFNCSNGDLYKWKHLWRVLAEQFDMEFEDFDDDDEGGSRPSMGEMMKDKGPVWDEIVRENGLVPTKLEEIGNWWFVDVMFGIESSVDSMNKSKEHGFVGFRNSKTSFVTWIDKMKSYKLVP

SEQ ID NO: 509 - protein, 388 aa, Daucus carota
MSWWWSGAVGAARKTLNQDKVPSSYESVALVVGITGIVGNSLAEILPLPDTPGGPWKVYGVARRPRPPWDANHPVEYIQCDISNPEETQSSLSRLNDVTHLFYVTWASRSTEAENCEINSKMFRNVLNCIIPNAPKLQHICLQTGKKHYFGSFEASGIAAHDPPYSEDLPRLESPNFYYNLEDILFEEVKKKDGLTWSVHRPGTIFGFSPHSMMNMICTLSVYAAICKHEGTVLRFPGTKEAWSLYSEASDADLIAEQEIWAAVDPYAKNEAFNCSNGDVFKWKHFWKVLAEQFEVECGEFEGDERLTLVELMKDKESVWDEIVKEYNLVPTKLEDIGVWWFVDYILGIEYPLDTMNKSKEHGFLGFRNSKSSFIHWIDKLKDSKIVP

SEQ ID NO: 510 - protein, 388 aa, Solanum tuberosum
MSWWWSRAIGATKEKVEEDDVPKKCQSVGLIIGVTGIVGNSLAEILPGTDTPGGPWKVYGVARRPRPSWNVNYPIEYIQCDISSPEETQSKLTLLTDVTHVFYVTWAIRPTELENCEINGKMFQNVLDAIIPNCPNLSHICLQTGLKHYHGSFELFEKIAHDTPYHEGLPRLPAPNFYYTLEDILFEEVKKKEGLTWSIHRPGLIFGFSPYSMMNIIGTLCVYATICKHEGLPLRFPGSKSAWDGYSYCSDADLIAEHQIWASMDPNAKNEAFNISNGDVFKWKHLWKVLAEEFQVEAEEFDESKRWTLVEMMKDKGQIWDEIVKENGLVESKLEEIGRWWFVDLVLKKECPLDTMNKSKEHGFLGFRNSKNAFISWIYKIKACKFVP

SEQ ID NO: 511 - protein, 396 aa, Setaria italica
MSWWWTGAIGAVKKRQDEQAAAAEPTYQSVALVVGSTGIVGTSLLDILPLADTPGGPWKVYALSRRPLPPWSPPPSPAVTHLHLDLADAAAVADALKPLTDITHVFYVAWTARPTEAENREANAAMLRNVLSVVVPNCPALVHVCLQTGRKHYVGPFEALGGVSFPDPPFTEDMPRLDCPNFYYDMEDILFDEVNRREGAVSWSVHRPTTVFGYSPRSAMNVVGSLCVYAAICRKEGATFRWPGSRIAWEGFSDASDADLIAEHEIWAAVDPFAKNEAFNCSNGDLYKWKYLWPILADHFGVEWAGYEGEENRFKLEEAMAGKEALWAEIVRENELISTELDEITNWWFVDAVFGVEFEHLDSMNKSKEHGFLGFRNTVNSFNTWIEKLKVFKIVP

SEQ ID NO: 512 - protein, 387 aa, Antirrhinum majus
MSWWYRRSIGETEQKRIEINGVSPTYQSVALIVGVTGIAGSGLAETLSFSDTPGGPWKVYGVARRPCPKWLAKLNVNYVQCDIANTDETYSKVAPLTDITHIFYVSWTGSEDVALNTLMFKNILDSVIPNAPNLKHVSLQTGIKYYWGNMAEMDSTNQPHECPFYENMPRLKQDNFYYNLEDLVYDSAVRKNGLSWSIHRPALIFGFSPCSMMNTVSTLCVYAAICKHENKPLVYTGTETSWTCLWDAVDSDLLAEHFLWAATVPNAKNQAFNINNGDVFKWKHMWKVLAKEFDIEAIGYEGKEPVLLEDLMKDKDSVWDEIVKKHDLVPTKLRDIAAFWLADVVFRNKETLCSMNKNKEFGFMGFRDTTKSFVSSINKMRDFKFIP

SEQ ID NO: 513 - protein, 386 aa, Coffea canephora
MTANWWWNRSISPRKCVENGGQKEHNSAALIIGITGIVGSSLAEMLLLHDTPGNPWKVYGVARRPRPTWLSDKRLNYIQCDISNSRETISKLSPLIDITHIFYVCWVGSEDCDLNGSMFRNVLRVVIPNAPNLQHVCLQTGIKYYLGVFDERYKQEPHESPFTEDLPRLPIPNFYYDLEDILEEETKAKLGLTWSAHRPALVFGFSPCSMMNMVSTISVYATICKHENKPLVYPGSDFSWDCYYDVVDADLLAEQQIWASMEPKAKNQAFNCSNGDVFKWKHIWKILAEQFGLEMVEYRKGQKETSMAELMKGKEPVWDEIVKKHKLVPTKLNDIAAFWLADVVFYSDNRVSCMNKSKELGFLRFKDSTKSFLDSIEKMRAYGFIP

SEQ ID NO: 514 - protein, 401 aa, Panicum hallii
MTSSMSWWWRGAPLKREDEQVAAAAEPSPFQSVALVVGSTGIVGTSLVDILPLPDTPGGPWKVYALSRRPLPPWSPPPPSSVTHLHLDLADPVAVAEALTPLNDVTHVFYAAWSPRATEAQNREVNSAMLRNVLSAVVPSCPAIVHISLQTGTKHYMGPPEAFGRTAALDPPYSEDMPRLDWPNFYYDQEDLLFDAVAQCGDGAAVSWSVHRPNLIFGFSPRSAMNIVCSICVYAAICRKEGVPLRWPGSLGTWEGFSSASDADLIAEQQIWAAVDPTAKNEAFNCSNGDIYKWRQLWPILAERFGLEWVGYEGEENRVKVSEAMAGKEPLWAEIVKENQLVPTQLHEVANWWFVDALFSVELEFLDSMNKSKEHGFLGFRNTIKSFKSWIDRMKAYNIVP

SEQ ID NO: 515 - protein, 321 aa, Oryza sativa
MVSSALPRGEPVTHICVDLADPAAVSAALAPLTDITHVFYVAWAPHFFEEDQNREANSRMLRNVLSAVVPNCPALVHVSLQTGSKHYIGPPESIGKFTIETPFSEDMPRLDNCPNLYYDQEDALFDAVSRSRRRGAAVISWSVHRPSLVFGFSPQSAMNVVCTLCVYAAICRKEGGRKLRWPGSLGAWEGFSNASDADLVAEQHIWAAVDPAARNEAYNCSNGDVRDGVVGVRGGGEQGEPDGGGIVREEGLVAAAELDQVANWWFVDALFMDKWEFLDTMNKSKEHGFLGFRNTVKSFGTWIDKLRLYKIVPSCRIVSSL

SEQ ID NO: 516 - protein, 397 aa, Setaria italica
MWAGAIGAAWKRQDDRAAVSSQSQQAFQSVALVVGSTGIVGASLVDILPLPDTPGGSWKVYALSRRSLPPWSPPSSSSVTHIKVDLTDSAAVAEALTPLTDVTHVHVFYVALSPRPTEAQSRETNSAMLRNVLSVVVPTARRSSTDQALLRPPRLQDPRPRAAVHRGGEDMPRLDIPVFYYDQEDVLLDAVARGAASAVSWSVHRPNLIFGFFPRSATNIICSLCVYAAICLKEDIKLRWPGTRSAWEGFNTCSDADLIAEQHIWAAVDPMARNEAFNCSNGDIYKWKKLWPVLAGRFGLEWAGYEGEENRFKVAEAMTGKEAVWAAIVAENDLAETKLDEVASWWLIDAVADQYGLDREILDSMNKSKEHGFLGFRNTVKSFNTWIDKLKAHKIVP

SEQ ID NO: 517 - protein, 367 aa, Sesamum indicum
MYLDTTSWWFKRSIGEVDKKKVEPNGVAPSYQSVALIVGVTGIAGSGSAGLANLHVEYVQCDIAKTEETYSKLSPLTDITHIFYVSWTGSEDCELNTLMFRNILDAVIPNAPNLKHLSLQTGIKYYWGNMAEMDSSNQPHDCPFYENMPRLKQENFYYNLEDLVYESALRKNSLTWSIHRPALIFGFSPCSMMNTVSTLSVYAAICKHENKPLVYTGTEVSWTCLWDAVDADLLAEHFLWTATDPKAKNQAFNINNGDVFKWKHMWDVLAQQFGLEAVGYEGKEPVLLEDLMKDKEGVWDEIVKKHDLVPTKLRDIAAFWLADVVFRNKETLCSMNKNREFGFMGFRDTTKSFVNTINKMRAYRFIP

SEQ ID NO: 518 - protein, 394 aa, Digitalis purpurea; identical to SEQ ID NO: 389

SEQ ID NO: 519 - protein, 396 aa, Digitalis lanata
MYTDTTTWWYKRSIGDIKQKNVETNGVALNYKSVALIVGVTGIAGSGLAETLSMSDTPGGPWKVYGVARRPCPEWLAKLHVSYIQCDIGSTDDTSAKLSPLSDITHIFYVSWTGSEDCDKNAIMFKNILDSVIPNAPNLKHISLQTGIKHYWGNMVDEMDITNVSHDCPFNEYMPRLRQPNFYSNLEDLLYEACRTQNGALTWTVHRPALIFGFSPCSLMNIVATLSVYAAICKYENKPLVYTGTQTSWNCLVDAVDSDLLSEHLVWGAISPNAKNQAFNINNGDVFKWKHIWKVLAEQLQLEIEFVGYEGKEPVSLEGLMKDKDSVWDEMVEKYDLVPTKLRDIAAFWFADVAFSIEGAVSSMNKNKEFGFMGFRDSTKSFISSVNKVRSYRFVP

SEQ ID NO: 520 - protein, 271 aa, Nepeta mussinii
MASTANPMQVMKKKLEGKVVIVTGGASGIGQTAARVFAQHGARAVVIADIQSEVGKSVAKSIGDPCCYVQCDVSDEEEVKSMIEWTASAYGGLDMMFSNVGIMSKSAQTVMDLDLLEFDKVMRVNARGMAACLKHAARKMVELGTRGTIICTTTPLSSRGGQSMTDYAMSKHAVMGLVRSASIQLGAHGIRVNCVTPSVVLTPLAQRMGLATPDDFHTHFGNFTSLKGVYLTPEQVAEAVVYLASDDAAFITGHDLVLDGGLLCLPFFAPS

SEQ ID NO: 521 - protein, 271 aa, Nepeta mussinii; identical to SEQ ID NO: 520

SEQ ID NO: 522 - protein, 321 aa, Nepeta cataria
MADKEGEVVCVTGGSGFIGSWLVSLLLRRGYSVRATVKNLGDERETKHLEAIEGADSRLSLFQIDLLDYDSVATAVGDAAGVFHLASPCTIDQVNDPQRELLDPAIKGTLNVLKAAKNLGVRRVVVTSSISAMIASSNSLAETGEDCWIDEDYCRQNGLWYPVSKALAEKAAWKLAEENGLDIVVVNPGMVVGPILPPALNSSMQLMLHVLQGKDFFEGFFMGLVHVKDVALAQILLYENTSASGRHLCVESLSRYDDFAKQMEKLYPEYKLPRFSNNAQHGSLKSDAALKKLRDLGIEFAPLEQIVKDSIESLRSKGYIS

SEQ ID NO: 523 - protein, 321 aa, Nepeta cataria; identical to SEQ ID NO: 522

SEQ ID NO: 524 - protein, 321 aa, Nepeta cataria
MADKEGEVVCVTGGSGFIGSWLVSLLLRRGYSVRATVKNLGDERETKHLEAIEGADSRLSLFQIDLLDYDSVATAVGDAAGVFHLASPCTIDQVNDPQRELLDPAIKGTLNVLKAAKNLGVRRVVVTSSIGAMIASSNSLAETGEDCWIDEDYCRQNGLWYPVSKALAEKAAWKLAEENGLDIVVVNPGMVVGPILPPALNSSMQLMLHVLQGKDFFEGFFMGLVHVKDVALAQILLYENTSASGRHLCVESLSRYDDFAKQMEKLYPEYKLPRFSNNAQHGSLKSDAALKKLRDLGIEFAPLEQIVKDSIESLRSKGYIS

SEQ ID NO: 525 - protein, 321 aa, Nepeta cataria; identical to SEQ ID NO: 524

SEQ ID NO: 526 - protein, 321 aa, Nepeta cataria
MADKEGEVVCVTGGSGFIGSWLVSLLLRRGYSVRATVKNLGDERETKHLEAIEGADSRLSLFQIDLLDYDSVATAVGDAAGVFHLASPCTIDQVNDPQRELLDPAIKGTLNVLKAAKNLGVRRVVVTSSISAMIASSNSLAETGEDCWIDEDYCRQNGLWYPVSKALAEKAAWKLAEENGLDIVVVNPGMVVGPILPPALNSSMQLMLHVLQGKDFFEGFFMGLVHVKDVALAQILLYENTSASGRHLCVESLSRYDDFAKQMEKLYPEYKLPRFSNNAQHGSLKSDAALKKLRDLGIEFAPLEQIVKDSIESLRSGGYIS

SEQ ID NO: 527 - protein, 321 aa, Nepeta cataria; identical to SEQ ID NO: 526

SEQ ID NO: 528 - protein, 321 aa, Nepeta cataria
MADKEGEVVCVTGGSGFIGSWLVSLLLRRGYSVRATVKNLGDERETKHLEAIEGADSRLSLFQIDLLDYDSVATAVGDAAGVFHLASPCTIDQVNDPQRELLDPAIKGTLNVLKAAKNLGVRRVVVTSSIGAMIASSNSLAETGEDCWIDEDYCRQNGLWYPVSKALAEKAAWKLAEENGLDIVVVNPGMVVGPILPPALNSSMQLMLHVLQGKDFFEGFFMGLVHVKDVALAQILLYENTSASGRHLCVESLSRYDDFAKQMEKLYPEYKLPRFSNNAQHGSLKSDAALKKLRDLGIEFAPLEQIVKDSIESLRSGGYIS

SEQ ID NO: 529 - protein, 321 aa, Nepeta cataria; identical to SEQ ID NO: 528

SEQ ID NO: 530 - protein, 321 aa, Nepeta cataria; identical to SEQ ID NO: 522

SEQ ID NO: 531 - protein, 321 aa, Nepeta cataria; identical to SEQ ID NO: 524

SEQ ID NO: 532 - protein, 321 aa, Nepeta cataria; identical to SEQ ID NO: 526

SEQ ID NO: 533 - protein, 321 aa, Nepeta cataria; identical to SEQ ID NO: 528

SEQ ID NO: 534 - protein, 490 aa, Nepeta cataria
MQYKLALNGKTLKGETTTEAVDAATAEKVFKQYANDNGVDGEWTYDDATKTFTVTEAFCRSSLLLRKALGGSRRAAAAATCSSAYACGWQSERGRWYSGGEGTTISAPGYHVNTAPSHMTGAVFWDKDKPITYEEFEMPRPKANEVLIKTKACGACHSDLHVIKGDLKFPCPCILGHEITGEVVEHGPLTETKYIERYPVGSKVIGAFIMPCGSCFYCSRGEDDLCEPYFAYNRAKGTLYDGQTRLFLRGSGKPVHMWSMSGLAEYCVTPVNGLGALPDTLPYAESSVLGCAVFTAYGAIAHAAEVKPGNSVAVIGIGGVGSSCLQIAKAFGASEIIAVDVEDGKLETAKTFGATHIINSRKEDAIAKIKELTDGRGVDIAVEAIGGPKTFAQCVGSVRAGGKAVMIGLSPTGGKGEVEITQLVRRKVKVIGSYGGRAMTDLPKLVELAEQGTFNLEAAVTRRYKFEEVAQAYQDLQNKTIVGRGVIEIM

SEQ ID NO: 535 - protein, 319 aa, Nepeta cataria
MSREGEGKVVCVTGASGYVASWLVKLLLQRGYTVRATVRNLSDPLKTEHLKALDGAAERLELFEADLVKEGSFDSVFHGCDGVFHTASPVIFRTTNPQADLIEPAVKGTVNVLRSCTKASSVRRVVLTSSTAAVVVNGRPFGPDVVVDETWFSDPHFCEKNKDWYCLSKTLAEEAAWKFAKENGIDLVVMNPGLVLGPLLQPTLNITSQVFLDIIKGKPIAPYYQCVDVRDLGDAHILGFEKSSASGRYILVGKTITHLQFMQLLHNLYPSIVDAPTSVADNPIGEVSKKKAESLGMSFMPLEVTVKDSVESLKEKNFL

SEQ ID NO: 536 - protein, 324 aa, Nepeta cataria
MKRVCVTGGTGFIASWLIKRLLHTGYSVNTTVRKNADGKRDLRYLTNLPGASENLNIFDADLDQPDSFTPAIEGCVGVFHIVHPMEWDETESEETKTKRVIGGLLAILKACLDSPTVRRFMHTSSSSAVVFDGKDLDTRDETSWSHLDLMRNMGLQGNSYTITKTLAERTALEFGKQHGLDVISLVPSWVHGPFFTPRCPNSVLVFLALILGDENYYKFLMKASVVHVDDVARAFVHLFECPEAEGRYICSALEVTIEELSEFLSQRYPQFHIPTADSFKGIEPVKLCGLSSKKLLETGFKYEYGLEEMFDGAIHSCKEKGILY

SEQ ID NO: 537 - protein, 333 aa, Nepeta cataria
MGEETNMKGKVCVTGGTGFLGSWMVKRLLQHGYSVNTTTRIQAGEKKRNIDYLRNLAGASERLHIFDADLDRPESFSAAIEGCVGVFHVAHPLDFEERETEEVKIKRVVNGTVGILQACVDAKTVKRVVYCSSVATAVFNDKAATLDKIDESSWTDVEFLRSLGVFGGAYSVTKTLVEQTVLEFGERNGLDVVAILPSWIHGPFISPYCPDSVSICMALIQGDKKSYQRLVRTSLVHVDDVVRAHIHLFEYPQAKGRYICSNVDITIDKLHEFLKANYPEYKLPSTEEFEDLIPVAFPELSSKKLLETGFKFENGLQEMFDGAIKSCKKMGLL

SEQ ID NO: 538 - protein, 319 aa, Nepeta cataria
MAEKGKCVCVTGAGGYVASWLINLLLSQGYTVHATLRNPGDEKNGHLHKLENAPQNLKLFKADLLDFDSILAAVKGCDGLFHVASPAPPASVPNPQVEIVEPAVKGTLNVLKACFEASVCRVVIVSSGVAVFMNPNWPKDKVLDESCWSDAEFCARTNNWYCYSKTAAEAEAWSYAETNGLVLVSVCPTLVLGPMLQQTPNSSSLILLKLLKEGYEVTEDHDRVIVDVRDVAEAMKLVYENREAKGRYICTSHTIKTRDLVQMLKQIYPNYHYPKSFKEGKELPQLSSGKLEGLGWKYKPLDETLVDSVENYKQIGLLM

SEQ ID NO: 539 - protein, 329 aa, Nepeta cataria
MEKSVKVCVTGGAGYIASFLIKHLLLRGYTVHATLRDLGDDSKVGLLKRLDHAETRLKLFAGDMYNPTEFADAIYGCEFVFHIATPMQHTEGSQYKNTCEAAVAGAKMIAESCIKSRTVKKLIYTASVTAASPLKGDASGYEDVMDETCWTPLNHSFQLHYDYVNSKTLAEKEVLSYNGAGMGVVSLACGLVGGETIQSFASGSMAVLISQATNDGTLYKALRELEDLDSKVPIVHLQDVMEAHMFAMENSDMNGRFLVASDFLKSAQIASLIQKHYPHINISSQLIEDTKRETKWGSRKLQDLGFEYKCDADKIIYGSIVCAKKFGLI

SEQ ID NO: 540 - protein, 320 aa, Nepeta cataria
MAEKDKTVCVTGAGGFVASWLVKLLLSQGYTVHGTVRNPGDEKNAHLKRLDNAAENLKLFKADLLDFGSIIEAVKGCVGVFHVACPVPGSSVPNPEVELVQPALNGTLNVLKACSEVKVGRVVVVSSVAAVSMIRDWPKDQVMDENCWSDKEYCKETNNWYCYSKTVAEAEAWEYSKKNGLNIVTVCPTLVLGPMLQHMANASSTSLITMLKESISDIENNLRKIVDVRDVAEALKLVYEKPEAEGRYICMAHMIKNADLMDMLKIFYPNYDYPNDVKEGKDEKKVSSEKLQKLGWKFRPLKETVVDSVESYKQLGFLWS

SEQ ID NO: 541 - protein, 329 aa, Nepeta cataria
MSIAAAKTVCVTGASGYIASWIVKFLLQKGYTVKASVRDPNDQKKTQHLLALDGAKERLHLMKANLLEEGSFDSVVDGCDGVFHTASPFYHAVTDPQVELIEPAVKGTLNVLGSCAKVPSVKRIVLTSSIAAVAYNGKPRTPEVVVDETWWSAPDVCEQMQMWYVLSKTLAEDAAWKFVKEKGIEMVTINPAMVIGPLLQPTLNTSSAAILNLINGAETYPNSTFGWINVKDVARAHILAFENTSASGRYCLVESVVHTSEVVKILHELYPTYKLPDKCADDKPFVPTYQVSKEKAKSLGIEFTPLKEGIKETVESLKEKDMFKPSAAV

SEQ ID NO: 542 - protein, 310 aa, Nepeta cataria
MAEKSKILIIGGTGYIGKFIVEASAKSGHPTFALVRESAVSDPAKSPLIQGFKDSGVTILIGDLKDHESLLKAIKQVDVVISTVGQMQLDDQVNIIAAIKEAGNIKRFFPSEFGNDVDRTRAVEPAKSAFAAKAKIRRAIEAQGIPYTYVSSNYFAGYSLPTLAQPGAFAPPPPRDKVVIYGDGNAKAVFNGEHDIGTYTIKAVDDPRTLNKIVYIKPPKNTYSFNELVALWEKKINKTLEKEFIPEEQLLKQIQESPIPVNIILSINHSIFVKGDQTYFTIEPSFGVEASELYPDVKYTTVEEFLDQFV

SEQ ID NO: 543 - protein, 344 aa, Nepeta cataria
MAEEVSNKQIIFNDYITGFPKESDMMLKTSTIKLEVPEGCDDVVLVKNLYLSCDPYMRSRMSKLDDNYVPIFTPGSPIMGYGVAKVVDSCSPNFKKGDLIWGMIGWEEYSLIKSTDGLFKIEHEDVPLSYYTGILGMPGISAYVGFYEICCPREGENVFVSAASGAVGQLVGQFAKLLGCYVVGSAGTQDKVDLLKNKFGFDEAFNYKEEVDLNAALKRHFPEGIDVYFENVGGKMLEAVLLNMNMKGRIAACGMISDYNLKEAQGVKNLFSIVAKQIRMQGFLVFHYYSLYPKFLDFILPLIKQGKITYVEDVAEGLESAPPALVGLFSGHNVGKQLVRVVSQ

SEQ ID NO: 544 - protein, 316 aa, Nepeta cataria
MEKNERKSKILIFGGSGYIGSCMVKGSLKLGHSTYVFSRPNSSKKHLLNEFQSLGAIIVKGKLDEHNKLVSVMKEVDVVISALAYPQVLDQFKILEAIKEAGNIKRFLPSDFGVEEDKISVLPPFEEFLDKKRKIRRAIEESKIPYTFVSADVFGAYFINYLLHPYDPNNHEITVYGSGRAKFVMNYEEDIGIYTIKVATDPRACNRTVIYRPSTNTLTQLELISKWENKIGKKFKKIHFPEEEVVALSQKLPNPDNIPVAILHSIFVKGVTTCYEFAEDDVEASSLYPDMKFTTIDELLDIFLHNPPKPASAAFE

SEQ ID NO: 545 - protein, 342 aa, Nepeta cataria
MAKVVLVTGASGYLGGRLCHALLNQGYSVKAFVRETSALSYLPPPRDGGDGGGSLQLVYGDVTDYPSLLEAFTGCHLVFHTAALVEPWIPDPARFISVNVGGLRNVLKAYKETETIEKIIYTSSFFALGSTDGYIADETQVHPAKHFCTEYEKSKTISDKIALDAAAEGVPIVPVYPGVIYGPGKVTTGNSVAHLLVERFSGRMPGYVGKEQGFSFCHVDDVVQGHLAAMAKGKKGERYLLTGENASFKDVFDIAADITQTSKPQFQIPLFLVDVYGWVCILISRMTGKLPLISPPVVDVLRHQWAYSCEKAKKELDYNPRSLREGLLEMLPWLKSLGLIKY

SEQ ID NO: 546 - protein, 324 aa, Nepeta cataria
MGKIVCVTGASGYIASWLVKLLLHRGYTVKATVRNLSDRSKVAHLTSLEGANDRLHLYEANLLEEGSFDTAVDGCEGVFHTASPVSLSVSDPQAELIDPAVKGTMNVLKSCKKVSTIKRVVVTSSIASVLYNYDSLNLKHDTIVDETWFSDPIFCEENKEWYALSKTLAEKAAWKFAEENGLDLVTLHPGYTIGPSLQPTLNMTYVALLNLIKEGKQLLANGVYRYVDVRDVALAHIIALENPSARGRYCLVGRVAYSFEALDILRMMFPTLKLPPIETKDRPSKPPYHVSKERAESLGVSFRPLEESLKDSVESFRDRNLITL

SEQ ID NO: 547 - protein, 279 aa, Nepeta cataria
MSTKMAEALEPWSDLEGKTVMVTGASSGLGHEFCLDLARAGCRIVAAARRTDRLKSLCDEINRMRGGGSCRAMAVELDVTAGGPTIAASVDRAWAAFGSIDTLINNAGVRGEVRSSLELSEEEWNSVVKTNLNGSWLVSKYVGEKMRRGGGGGSIINISSISGLNRAQLRGGIAYSSSKAGLDSMTKIMALELGDHNIRVNSIAPGLFRSAITEDLVKKDWLKNVAERSVPLRTFGTSDPALTSLIRYLIHHSSSYVSGNIFIVDAGYTLPGYPIFSSL

SEQ ID NO: 548 - protein, 344 aa, Nepeta cataria
MEENLVGNKQIIFKGYIERVPKESDMELKLGNKIKLEAPEGSGAFLVKNLYLSCDPYMRGRMRDFHGSYIPPFLPGSVVEGFGVSKVIDSDNPNFKPGDIVSGFTGWEEYSLLHNTEQLRRVEPDNIPLSYHIGLLGMPGFTAYAGFYKVCDPKRNEHVFVSAASGAVGQLVGQLAKLHGCYVVGSAGSDQKVDLLKKKLGFDEAFNYKQEPDLDAALKKYFPEGIDIYFENVGGAMLEAVLLNMRVHGRIAVCGMVSQNGMDEQGIRNLFSLIPKRVRMQGFLQSDYLHLFPKFVEEVGNLYKEGKITYLEDMNQGLESGPCAFAGLFSGINIGKQVICVSPA

SEQ ID NO: 549 - protein, 321 aa, Nepeta cataria; identical to SEQ ID NO: 522

SEQ ID NO: 550 - protein, 315 aa, Nepeta cataria
MADAVVQPAAQRYALITGANKGIGFQICRQLESKGIVVILASRDEKRGIKARERLLKEFGVSSDNVVLHQLDVVDPASVAAVYEFIESRFGRLDILVNNAGIRGADVDGDVSLLEEYIKADGATISAGGKAEPFHPKANGRLVETFENAEECIETNYYGAKRVTEALLPLLHQSDSPRIVNVSSLLGSLVLQTNERAKGVFSNEEGLTQDKVDEVVQEFLKDFKEGKLEENNWPPHFPAYKVSKEALNAYTMLLAKRNPSFCTNAVCPGFSRTDMTFNSGLISESEAAEAPVKLALLPDGGPSGSFFYREEALSL

SEQ ID NO: 551 - protein, 310 aa, Nepeta cataria
MKAWTYKEYGGIEVLKLDSDVPIPEPKAEEVLIKVAAVGLNPIDFKRRLGFYEADRAPFPVVPGYDVAGVVVKVGNRVMNFEEGDEVYGDVVETALQDPRSLGTLAEYTIAEEKLLALKPRNLDFAEAASLPVAIQTAYQGLERARFSEGKSILVLGGAGGVGSLVIQVARYVFGASKIAATCSTANMDLVESLGADLVIDYSNHNFENYPDKFDVVFDTIGQSDRATKALKEGGCVVVIVGEHVDPPMFSFTLTASGEYLNMLNPYLETGMLKPVLDPNGTFPFDQVNEAFSYLESNRAIGKVVVYPIS

SEQ ID NO: 552 - protein, 183 aa, Nepeta cataria
MSKSLGFMKSVRPIALPLICLSELISTPIILDAPRALAPSTTANPTAPRPKTATVDPSSTSAVFHTAPRPVETPQLSRVIFSKEALRSILTTQAESSTVYSLNVEVLRKWKIGFPSFVENRHFPSPVMVLFIGFTLYFWHKLVFFDLQYTQFWHSPLKIGTMWSPISISLTPSPTLSTTPEAS

SEQ ID NO: 553 - protein, 188 aa, Nepeta cataria
MSSIPQRLAMDFPTSITKRYLTSDLASRSIAVFTSSMPISSMSAVMPCFPQKSNISCVSFTPPKSLPPMSFRPATRGKIGRSRGLLGNPTVISFPFIFNRLSNGVNWCTAAMVSMMKSIVPVAAFSCSASVLTTKASAPSLFMASIFFFGDVLITVTFIPKAFPNLTATWPSPPSPATPKCFPASVIP

SEQ ID NO: 554 - protein, 188 aa, Nepeta cataria
MSSSPQRLAMDFPTSITKRYLTSDLASRSIAVFTSSMPISSMSAVMPCFPQKSNISCVSFTPPKSLPPMSFRPATRGKIGRSRGLLGNPTVISFPFIFNRLSNGVNWCTAAMVSMMKSIVPVAAFSCSASVLTTKASAPSLFMASIFFFGDVLITVTFIPKAFPNLTATWPSPPSPATPKCFPASVIP

SEQ ID NO: 555 - protein, 382 aa, Nepeta cataria
MSSTKGQVIRCKAAVAWEAGKPLVIEEVEVAPPQKMEVRVKILFTSLCHTDVYFWEAKGQTPLFPRIFGHEAGGIVESVGEGVTELAPGDHVLPVFTGECKECRHCKSAESNMCDLLRINTDRGVMIEDGKSRFSKDGKEIYHFVGTSTFSEYTVVHVGCLAKINPAAPMDKVCILSCGISTGLGASLNVAKPTKGSTVAIFGLGAVGLAAAEGARIAGASRIIGVDLNANRFNEAKKFGVTEFVNPKDHEKPIQEVLVEMTDGGVDRSVECTGNVNAMISAFECVHDGWGVAVLVGVPNKDDTFKTHPVNLLNERTLKGTFFGNYKPRTDIPVVVEKYMNKEMDLQLEKFITHRISFSEINKAFDYMLRGESIRCIITMEN

SEQ ID NO: 556 - protein, 327 aa, Nepeta cataria
MEVRIRVLFTSICHTDLSAWKGETEAHRVYPRIFGHEASGVVESVGEGVSDIEIGDHIVPIFNGECQNCVYCKSKKTNLCQKYRVNPMKSTMTGDGKCRFSTKEGNPIFHFLNTSTFSEYTVLDSACVVKIDRKASLEKMTLLSCGVSTGLGAVWNTADVEEGSTVAVFGLGAVGLAVVEGARARGASRIIGVDINSDKQIKGRAIGLTDFINPKDLDIPVHQKIREMANGGVDYSFESAGNLDVLREAYLSTHDGWGFTVILGIHPTPRMLPLHPMELFDGRRIVASVFGDFKGKSQLPHFANQCIKGEVKLDEFITHEIDRKSVV

SEQ ID NO: 557 - protein, 240 aa, Nepeta cataria
MKSTMTGDGKCRFSTKEGNPIFHFLNTSTFSEYTVLDSACVVKIDRKASLEKMTLLSCGVSTGLGAVWNTADVEEGSTVAVFGLGAVGLAVVEGARARGASRIIGVDINSDKQIKGRAIGLTDFINPKDLDIPVHQKIREMANGGVDYSFESAGNLDVLREAYLSTHDGWGFTVILGIHPTPRMLPLHPMELFDGRRIVASVFGDFKGKSQLPHFANQCIKGEVKLDEFITHEIDRKSVV

SEQ ID NO: 558 - protein, 281 aa, Nepeta cataria
MPCGSCFFCSKGQDDLCESFFAYNRAKGTLYDGETRLFLRGSGKPVYMYSMGGLAEFCVVPAHGLTSLPNTLPYTESAVLGCAVFTAYGAMAHAAQVRPGDSVAVIGIGGVGSSCLQIAKAFGASEIIAVDVQDEKLEKAKILGATHAINSRKEDAVAKIKEITGGRGVDVAVEALGRPQTFSQCVQCVQDGGKAVMIGLTLSGAKGEVDINHLVRRQIKVIGSYGGRARQDLPKLVKLAEKGTFNLQAAVSRKYKFEEVEEAYKNLDQGSIVGRGVVEIM

SEQ ID NO: 559 - protein, 355 aa, Nepeta cataria
MGSHGEEENMAAWLLGINNLKILPFKLPLLGPHDARIRMKAVGICGSDVHYLKEMKLADFIVTEPMVIGHECAGIVEEVGAEVKHLVPGDRVAIEPGISCWRCNLCKEGRYNLCPEMKFFATPPVHGSLANQIVHPADLCFKLPNNVSLEEGAMCEPLSVGVHACRRANVGPETNVLVMGAGPIGLVTLLSARAFGSPRIVIVDVDDHRLSVAKSLGADETIKVSTNVNDVGAEVECIKAAMGGTIDIALDCAGFSKTMSTALAATSSGGKVCLVGMGHTEMTVPLAPAAVREVDLVGIFRYKNTWPLCIEFLQSGKIDVKPLITHRFGFSQKEVEDAFETSARGGTAIKVMFNL

SEQ ID NO: 560 - protein, 355 aa, Nepeta cataria
MAKSVNAVGWAARDTSGVLSPLKFARPAAGDRDVQFKVLYCGICHSDLHSIKNEWGHTQYPIIPGHEIVGVVTAVGPKATKFKAGDKVGVGCLVNSCRNCNQCAADLENYCPKIVQTYNSVLADGSVTYGGYSDVMTADEDFVIRWPENFPMDKGAPLLCAGVTTYSPLRYYGLDKPGLHIGVVGLGGLGHVAVKFAKAFGTKVTVISTSAGKKKEAIETLGADAFLISKDASEMQAAAGTLDGMIDTVSAQHPLPPLLSLLKPHGKLILVGAPEKPLELPAFPLLMGRKMVAGSIIGGIKETQEMIDFAAKHNILPDVEMIPMDYVNTAMERLAKADVKYRFVIDVGNTLTKAD

SEQ ID NO: 561 - protein, 359 aa, Nepeta cataria
MAKTPETEHPVKAFGYAATDNSGTFSPFKFSRRATGERDVQFKVLYCGVCHSDLHMVKNEWGVTHYPIVPGHEIVGVATEVGSKVEKVKVGDKVGVGVIVGSCRQCDQCSNDLENYCSKQILTYGAPYLDGTITRGGYSDIMVADEHFIIRWPENFPLDAGAPLLCAGITTYSPLRYFGLDKPGLRVGVNGLGGLGHVAVKFAKAFGTKVTVISSSLRKKKEAVEKLGVDEFLVSTDPEQMQAAIGTLDGIIDTVSAEHSVVSLLSLLKPHGRLIVVGAPEKPHQLPAFPLITGRKSISGSAIGGMKETQEMIDFAAKHNILPDVEVIPIDYINTAMERLLKSDVKYRFVIDVEKSLKA

SEQ ID NO: 562 - protein, 316 aa, Nepeta cataria
MYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGVVGLGGLGHIAVKFAKAFGHHVTIISTSPSKEKEAREKLGADDFILSTDAKQMMTKKRSLDFILDTVSAKHSLGPLLELLKVKGTLVIVGAPEKPMDLPSFPLIFGKRVVKGSMIGSIKETQDMMDVCGKHNITCDIEVVNTDNINEALDRLAKNDVKYRFVIDITAKSTPKRSEERRVGKECRSRWSPYH

SEQ ID NO: 563 - protein, 208 aa, Nepeta cataria
MAEFQQKAFGLAAKDSSGVLSPFHFSRRDNGADDVTIKILYCGVCHSDLHTVKNEWGFTQYPVVPGHEISGLVTKIGNNVEKFKVGDRVGVGVIVGSCRTCDLCQQDLESYCPKMIFTYNATDKDGTRTYGGYSDIIVVDQHFVIRFPDNVPSDAGAPLLCAGITVYSPMKYYGMTEAGKHLGVAGLGGLGHVAVKFGKAFGDRKSVV

SEQ ID NO: 564 - protein, 355 aa, Nepeta cataria
MAKSVNAVGWAARDTSGLLSPLKFARPAAGDRDVQFKVLYCGICHSDLHSIKNEWGNTQYPIVPGHEIVGVVTAVGPKATKFKAGDKVGVGCLVNSCRHCDQCAADLENYCPQLVQTYNSVLADGSVTYGGYSDVMTADEDFVIRWPENFPMDKGAPLLCAGVTTYSPLRYYGLDKPGLHIGVVGLGGLGHVAVKFAKAFGTKVTVISTSAGKKKEAIETLGADAFLISKDASEMQAAAGTLDGMIDTVSAQHPLPPLLSLLKPHGKLILVGAPDKPLELPAFPLIMGRKMVAGSIIGGMKETQEMIDFAAKHNILPDVEMIPMDYVNTAMERLAKADVKYRFVIDVGNTLTKAD

SEQ ID NO: 565 - protein, 298 aa, Nepeta cataria
MYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGVVGLGGLGHIAVKFAKAFGHHVTIISTSPSKEKEAREKLGADDFILSTDAKQMMTKKRSLDFILDTVSAKHSLGPLLELLKVKGTLVIVGAPEKPMDLPSFPLIFGKRVVKGSMIGSIKETQDMMDVCGKHNITCDIEVVNTDNINEALHRLAKNDVKYRFVIDIAAKSSPNI

SEQ ID NO: 566 - protein, 355 aa, Nepeta cataria
MAKSVNAVGWAARDTSGLLSPLKFARPAAGDRDVQFKVLYCGICHSDLHSIKNEWGNTQYPIVPGHEIVGVVTAVGPKATKFKAGDKVGVGCLVNSCRHCDQCAADLENYCPQLVQTYNSVLADGSVTYGGYSDVMTADEDFVIRWPENFPMDKGAPLLCAGVTTYSPLRYYGLDKPGLHIGVVGLGGLGHVAVKFAKAFGMKVTVISTSAGKKKEAIETLGADAFLISRDASEMQAAAGTLDGMIDTVSAQHPLPPLLSLLKPHGKLILVGAPEKPFELPAFPLLMGRKTVAGSVIGGLKETQEMIDFAAKHNLLPEVEMIPMDYVNTAMERLAKADVKYRFVIDVGNTLTKAD

SEQ ID NO: 567 - protein, 355 aa, Nepeta cataria
MAKSVNAVGWAARDTSGLLSPLKFARPAAGDRDVQFKVLYCGICHSDLHSIKNEWGNTQYPIVPGHEIVGVVTAVGPKATKFKAGDKVGVGCLVNSCRHCDQCAADLENYCPQLVQTYNSVLADGSVTYGGYSDVMTADEDFVIRWPENFPMDKGAPLLCAGVTTYSPLRYYGLDKPGLHIGVVGLGGLGHVAVKFAKAFGTKVTVISTSAGKKKEAIETLGADAFLISKDASEMQAAAGTLDGMIDTVSAQHPLPPLLSLLKPHGKLILVGAPEKPLELPAFPLLMGRKMVAGSIIGGIKETQEMIDFAAKHNILPDVEMIPMDYVNTAMERLAKADVKYRFVIDVGNTLTKAD

SEQ ID NO: 568 - protein, 355 aa, Nepeta cataria
MAEFQQKAFGLAAKDSSGVLSPFHFSRRDNGADDVTIKILYCGVCHSDLHTVKNEWGFTQYPVVPGHEISGLVTKIGNNVEKFKVGDRVGVGVIVGSCRTCDLCQQDLESYCPKMIFTYNATDKDGTRTYGGYSDIIVVDQHFVIRFPDNVPSDAGAPLLCAGITVYSPMKYYGMTEAGKHLGVAGLGGLGHVAVKFGKAFGMKVTVISTSPKKKIEAINKLGADAFVVSTDAEQLKAATGTMDFIIDTIAAVHQLTPLLSLLKMNGKLITVGLPNKPLDLPIFPLVAGRKLIGGSDFGGVKETQEMLDFCGKHGITADIELIGIEDVNTAMERLAKSDVRYRFVIDVGKSIANL

SEQ ID NO: 569 - protein, 171 aa, Nepeta cataria
MYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGVVGLGGLGHIAVKFAKAFGHHVTIISTSPSKEKEAREKLGDRKSVV

SEQ ID NO: 570 - protein, 353 aa, Nepeta cataria
MTTANGECIGWAARDPCGTLSPYRFSRRSVGADDVYISIMYCGVCYADVIWTRNVMGHSNYPLVPGHEIVGIVKEVGSNVDRFKVGEHIGVGTYVNSCRECEYCDNQIEVHCSKGSILTFDGVDFDGTITKGGYSSYIVVHQRYCFVIPENYPPQLAAPLLCAGITVYTPMMRNNMNQPGKSLGVIGLGGLGHLAVKFGKAFGLKVTVFSTSISKKDEALNLLGADNFVLSSDEKEMKALKGSIDFIINTASGDISFDLYLSLLKTMGVFVLVGFPSEVKFLPGSLNLGAKTVTGSITGGTKQTQEMLAFCASHKIYPEIELIPIHYCNEALERLVKKDVKYRFVIDIANSLA

SEQ ID NO: 571 - protein, 314 aa, Nepeta cataria
MYCGVCYADVIWTRNVMGHSNYPLVPGHEIVGIVKEVGSNVDRFKVGEHIGVGTYVNSCRECEYCDNQIEVHCSKGSILTFDGVDFDGTITKGGYSSYIVVHQRYCFVIPENYPPQLAAPLLCAGITVYTPMMRNNMNQPGKSLGVIGLGGLGHLAVKFGKAFGLKVTVFSTSISKKDEALNLLGADNFVLSSDEKEMKALKGSIDFIINTASGDISFDLYLSLLKTMGVFVLVGFPSEVKFLPGSLNLGAKTVTGSITGGTKQTQEMLAFCASHKIYPEIELIPIHYCNEALERLVKKDVKYRFVIDIANSLA

SEQ ID NO: 572 - protein, 227 aa, Nepeta cataria
MYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGIVGLGGLGHIAVKFAKAFGHHVTIISTSPSKENEAREKLGADDFILSTDAKQMMTKKRSLDFILDTVSAKHSLGPLLELLKVKRSEERRVGKECRSRWSPYH

SEQ ID NO: 573 - protein, 264 aa, Nepeta cataria
MYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGVVGLGGLGHIAVKFAKAFGHHVTIISTSPSKEKEAREKLGADDFILSTDAKQMMTKKRSLDFILDTVSAKHSLGPLLELLKVKGTLVIVGAPEKPMDLPSFPLIFGKRVVKGSMIGSIKERSEERRVGKECRSRWSPYH

SEQ ID NO: 574 - protein, 374 aa, Nepeta cataria
MSAIRCKAAVAWAAGEPLVIEEVELSPPQPMEIRIKVVCTSLCRSDLTAWLSQAQPQLFPRIFGHEASGVVESVGEGVTEFEVGDHVLTLFTGECMKCKPCASGKSNTCHTLGLERQGVMHSDKKTRFSIKGKHVYHYCAVSSFSEYTVVHSGCAVKISPIAPLEKICLLSCGVAAGLGAAWKVANISEGSTVAIFGLGTVGLSVAQGAKRRGASRIIGIDTNPKKSETAKAFGVTDFVNPNDHDQPIQQVIIGITDGGADYAFECVGDTGMITAALQSCCAGWGLTVTLGVPKEEPGITAHYGLFLSGRTLTGSLFGGWKPKSDLPSLVDMYLKKEIEIDKYITHNLMFEDINEAFELMGKGKCLRCVIHMPK

SEQ ID NO: 575 - protein, 377 aa, Nepeta cataria
MGSLGSNNHSDHIFISNETIGKVITCKAAVAYAAGEPLVVEEIRVDPPQKMEVRIRVLFTSICHTDLSAWKGETEAHRVYPRIFGHEASGVVESVGEGVSDIEIGDHIVPIFNGECQNCVYCKSKKTNLCQKYRVNPMKSTMTGDGKCRFSTKEGNPIFHFLNTSTFSEYTVLDSACVVKIDRKASLEKMTLLSCGVSTGLGAVWNTADVEEGSTVAVFGLGAVGLAVVEGARARGASRIIGVDINSDKQIKGRAIGLTDFINPKDLDIPVHQKIREMANGGVDYSFESAGNLDVLREAYLSTHDGWGFTVILGIHPTPRMLPLHPMELFDGRRIVASVFGDFKGKSQLPHFANQCIKGEVKLDEFITHEIDRKSVV

SEQ ID NO: 576 - protein, 243 aa, Nepeta cataria
MSAIRCKAAVAWAAGEPLVIEEVELSPPQPMEIRIKVVCTSLCRSDLTAWLSQAQPQLFPRIFGHEASGVVESVGEGVTEFEVGDHVLTLFTGECMKCKPCASGKSNTCHTLGLERQGVMHSDKKTRFSIKGKHVYHYCAVSSFSEYTVVHSGCAVKISPIAPLEKICLLSCGVAAGLGAAWKVANISEGSTVAIFGLGTVGLSVAQGAKRRGASRIIGIDTNHRSEERRVGKECRSRWSPYH

SEQ ID NO: 577 - protein, 178 aa, Nepeta cataria
MSAIRCKAAVAWAAGEPLVIEEVELSPPQPMEIRIKVVCTSLCRSDLTAWLSQAQPQLFPRIFGHEASGVVESVGEGVTEFEVGDHVLTLFTGECMKCKPCASGKSNTCHTLGLERQGVMHSDKKTRFSIKGKHVYHYCAVSSFSEYTVVHSGCAVKISPIAPLEKICLLSCGVAAGT

SEQ ID NO: 578 - protein, 435 aa, Nepeta cataria
MAFCRSSLLLRKALGGSRRAAAAATCSSAYACGWQSERGRWYSGGEGTTISAPGYHVNTAPSHMTGAVFWDKDKPITYEEFEMPRPKANEVLIKTKACGACHSDLHVIKGDLKFPCPCILGHEITGEVVEHGPLTETKYIERYPVGSKVIGAFIMPCGSCFYCSRGEDDLCEPYFAYNRAKGTLYDGQTRLFLRGSGKPVHMWSMSGLAEYCVTPVNGLGALPDTLPYAESSVLGCAVFTAYGAIAHAAEVKPGNSVAVIGIGGVGSSCLQIAKAFGASEIIAVDVEDGKLETAKTFGATHIINSRKEDAIAKIKELTDGRGVDIAVEAIGGPKTFAQCVGSVRAGGKAVMIGLSPTGGKGEVEITQLVRRKVKVIGSYGGRAMTDLPKLVELAEQGTFNLEAAVTRRYKFEEVAQAYQDLQNKTIVGRGVIEIM

SEQ ID NO: 579 - protein, 222 aa, Nepeta cataria
MVVHHHFIVRIPDNMPLDAAAPLLCAGITTYSPLRYFGLDKPGLHIGVVGLGGLGHLAVKFAKAFGAKVTVISTSPNKKDQALSHLGADSFLISKNACEMKGAMGTMDGILDTVSAVHPVMELVGLLKAQGKLIMLGAPEKPLELTAFPLIAGRKMIAGSGIGGMKETQEMIDFAAKHNIKADIELIPMDYVNTAMDRLAKADVKYRFVIDVANTIKNSLLL

SEQ ID NO: 580 - protein, 379 aa, Nepeta cataria
MAQATPNHTQTVSGWAAHDTSGKITPYTFKRRENGEDDVTIKILYCGICHTDLHFAKNEWGITMYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGVVGLGGLGHIAVKFAKAFGHHVTIISTSPSKEKEAREKLGADDFILSTDAKQMMTKKRSLDFILDTVSAKHSLGPLLELLKVKGTLVIVGAPEKPMDLPSFPLIFGKRVVKGSMIGSIKETQDMMDVCGKHNITCDIEVVNTDNINEALDRLAKNDVKYRFVIDITAKSTPKRSEERRVGKECRSRWSPYH

SEQ ID NO: 581 - protein, 361 aa, Nepeta cataria
MAQATPNHTQTVSGWAAHDTSGKITPYTFKRRENGEDDVTIKILYCGICHTDLHFAKNEWGITMYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGVVGLGGLGHIAVKFAKAFGHHVTIISTSPSKEKEAREKLGADDFILSTDAKQMMTKKRSLDFILDTVSAKHSLGPLLELLKVKGTLVIVGAPEKPMDLPSFPLIFGKRVVKGSMIGSIKETQDMMDVCGKHNITCDIEVVNTDNINEALHRLAKNDVKYRFVIDIAAKSSPNI

SEQ ID NO: 582 - protein, 298 aa, Nepeta cataria
MYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGVVGLGGLGHIAVKFAKAFGHHVTIISTSPSKEKEAREKLGADDFILSTDAKQMMTKKRSLDFILDTVSAKHSLGPLLELLKVKGTLVIVGAPEKPMDLPSFPLIFGKRVVKGSMIGSIKETQDMMDVCGKHNITCDIEVVNTDNINEALDRLAKNDVKYRFVIDITAKSTPKI

SEQ ID NO: 583 - protein, 234 aa, Nepeta cataria
MAQATPNHTQTVSGWAAHDTSGKITPYTFKRRENGEDDVTIKILYCGICHTDLHFAKNEWGITMYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGVVGLGGLGHIAVKFAKAFGHHVTIISTSPSKEKEAREKLGDRKSVV

SEQ ID NO: 584 - protein, 314 aa, Nepeta cataria
MYCGVCYADVIWTRNVMGHSNYPLVPGHEIVGIVKEVGSNVDRFKVGEHIGVGTYVNSCRECEYCDNQIEVHCSKGSILTFDGVDFDGTITKGGYSSYIVVHQRYCFVIPENYPPQLAAPLLCAGITVYTPMMRNNMNQPGKSLGVIGLGGLGHLAVKFGKAFGLKVTVFSTSISKKHEALNLLGADNFVLSSDEKEMKALKGSIDFIINTASGDISFDLYLSLLKTMGVFVLVGFPSEVKFLPGSLNLGSKTVTGSITGGTKQTQEMLAFCASHKIYPEIELIPIHYCNEALERLVKKDVKYRFVIDIANSLA

SEQ ID NO: 585 - protein, 327 aa, Nepeta cataria
MAQATPNHTQTVSGWAAHDTSGKITPYTFKRRENGEDDVTIKILYCGICHTDLHFAKNEWGITMYPVVPGHEITGIITKVGSNVTGFKVGDRAGVGCLAATCLKCECCQEGQENYCDDVQFVYNGIFWDGSITYGGYSDFLVADHRYVVRVPENLPMDAAAPLLCAGITVYAPMKDNNLLETKGKHVGVVGLGGLGHIAVKFAKAFGHHVTIISTSPSKEKEAREKLGADDFILSTDAKQMMTKKRSLDFILDTVSAKHSLGPLLELLKVKGTLVIVGAPEKPMDLPSFPLIFGKRVVKGSMIGSIKERSEERRVGKECRSRWSPYH

SEQ ID NO: 586 - protein, 379 aa, Nepeta cataria
MATHGQVITCKAAVAWEPNKPLVIEEVQVAPPQAGEVRIQILFTALCHTDAYTWSGKDPEGLFPCILGHEAAGIVESVGEGVTEVQLGDHVIPCYQAECSECKFCKSGKTNLCGKVRVATGVGVMMTDRKSRFSVNGKPIYHFMGTSTFSQYTVVHDVSVAKIDPVAPLEKVCLLGCGVPTGLGAVWNTAKVEPGSIVAIFGLGTVGLAVAEGAKAAGASRVIGIDIDAKKFDRAKDFGVTECINPKDHEKPIQQVIVDLTDGGVDYSFECIGNVSVMRSALECCHKGWGTSVIVGVAASGQEISTRPFQLVTGRVWKGTAFGGFKSRSQVPWLVDKYLKKEIKVDEYITHNSTLAEINKAFDMMHEGMCLRVVLDMNM

SEQ ID NO: 587 - protein, 234 aa, Nepeta cataria
MYSMGGLAEFCVVPAHGLTSLPNTLPYTESAVLGCAVFTAYGAMAHAAQVRPGDSVAVIGIGGVGSSCLQIAKAFGASEIIAVDVQDEKLEKAKILGATHAINSRKEDAVAKIKEITGGRGVDVAVEALGRPQTFSQCVQCVQDGGKAVMIGLTLSGAKGEVDINHLVRRQIKVIGSYGGRARQDLPKLVKLAEKGTFNLQAAVSRKYKFEEVEEAYKNLDQGSIVGRGVVEIM

SEQ ID NO: 588 - protein, 171 aa, Nepeta cataria; identical to SEQ ID NO: 569

SEQ ID NO: 589 - protein, 208 aa, Nepeta cataria
MAKFQQKAFGLAAKDSSGVLSPFHFSRRDNGANDVTIKTLYCGICHSDLHTVKNEWGFTQYPVVPGHEISGLVTKVGNNVEKFKVGDRVGVGVIVGSCRTCDLCQQDLESYCPKMIFTYNATDKDGTRTYGGYSDIIVVDQHFVIRFPDNVPSDAGAPLLCAGITVYSPMKYYGMTEAGKHLGVAGLGGLGHVAVKFGKAFGDRKSVV

SEQ ID NO: 590 - protein, 355 aa, Nepeta cataria
MAKFQQKAFGLAAKDSSGVLSPFHFSRRDNGANDVTIKTLYCGICHSDLHTVKNEWGFTQYPVVPGHEISGLVTKVGNNVEKFKVGDRVGVGVIVGSCRTCDLCQQDLESYCPKMIFTYNATDKDGTRTYGGYSDIIVVDQHFVIRFPDNVPSDAGAPLLCAGITVYSPMKYYGMTEAGKHLGVAGLGGLGHVAVKFGKAFGMKVTVISTSPKKKIEAINKLGADAFVVSTDAEQLKAATGTMDFIIDTIAAVHQLTPLLSLLKMNGKLITVGLPNKPLDLPIFPLVAGRKLIGGSDFGGVKETQEMLDFCGKHGITADIELIGIEDVNTAMERLAKSDVRYRFVIDVGKSIANL

SEQ ID NO: 591 - protein, 319 aa, Nepeta cataria; identical to SEQ ID NO: 535

SEQ ID NO: 592 - protein, 324 aa, Nepeta cataria; identical to SEQ ID NO: 536

SEQ ID NO: 593 - protein, 333 aa, Nepeta cataria; identical to SEQ ID NO: 537

SEQ ID NO: 594 - protein, 319 aa, Nepeta cataria; identical to SEQ ID NO: 538

SEQ ID NO: 595 - protein, 329 aa, Nepeta cataria; identical to SEQ ID NO: 539

SEQ ID NO: 596 - protein, 320 aa, Nepeta cataria; identical to SEQ ID NO: 540

SEQ ID NO: 597 - protein, 329 aa, Nepeta cataria; identical to SEQ ID NO: 541

SEQ ID NO: 598 - protein, 310 aa, Nepeta cataria; identical to SEQ ID NO: 542

SEQ ID NO: 599 - protein, 344 aa, Nepeta cataria; identical to SEQ ID NO: 543

SEQ ID NO: 600 - protein, 316 aa, Nepeta cataria; identical to SEQ ID NO: 544

SEQ ID NO: 601 - protein, 342 aa, Nepeta cataria; identical to SEQ ID NO: 545

SEQ ID NO: 602 - protein, 324 aa, Nepeta cataria; identical to SEQ ID NO: 546

SEQ ID NO: 603 - protein, 279 aa, Nepeta cataria; identical to SEQ ID NO: 547

SEQ ID NO: 604 - protein, 344 aa, Nepeta cataria; identical to SEQ ID NO: 548

SEQ ID NO: 605 - protein, 321 aa, Nepeta cataria; identical to SEQ ID NO: 522

SEQ ID NO: 606 - protein, 315 aa, Nepeta cataria; identical to SEQ ID NO: 550

SEQ ID NO: 607 - protein, 310 aa, Nepeta cataria; identical to SEQ ID NO: 551

SEQ ID NO: 608 - protein, 863 aa, Artificial Sequence
  source: /note="Description of Artificial Sequence: Synthetic polypeptide"
MIMELVEATRRTLRNESSDSTEKMRLIDSLQRLGLNHHFEQDIKEMLQDFANEHKNTNQDLFTTSLRFRLLRHNGFNVTPDVFNKFTEENGKFKESLGEDTIGILSLYEASYLGGKGEEILSEAMKFSESKLRESSGHVAPHIRRQIFQSLELPRHLRMARLESRRYIEEDYSNEIGADSSLLELAKLDFNSVQALHQMELTEISRWWKQLGLSDKLPFARDRPLECFLWTVGLLPEPKYSGCRIELAKTIAVLLVIDDIFDTYGSYDQLILFTNAIRRWDLDAMDELPEYMKICYMALYNTTNEICYKVLKENGWSVLPYLERTWIDMVEGFMLEAKWLNSGEQPNLEAYIENGVTTAGSYMALVHLFFLIGDGVNDENVKLLLDPYPKLFSSAGRILRLWDDLGTAKEEQERGDVSSSIQLYMKEKNVRSESEGREGIVEIIYNLWKDMNGELIGSNALPQAIIETSFNMARTSQVVYQHEDDTYFSSVDNYVQSLFFTPVSVSVGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFETAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 609 - protein, 903 aa, Artificial Sequence
  source: /note="Description of Artificial Sequence: Synthetic polypeptide"
MSSSSSSSSSMSLPLATPLIKDNESLIKFLRQPLVLPHEVDDSTKRRELLERTRKELELNAEKPLEALKMIDIIQRLGLSYHFEDDINSILTGFSNISSQTHEDLLTASLCFRLLRHNGHKINPDIFQKFMDNNGKFKDSLKDDTLGMLSLYEASYLGANGEEILMEAQEFTKTHLKNSLPAMAPSLSKKVSQALEQPRHRRMLRLEARRFIEEYGAENDHNPDLLELAKLDYNKVQSLHQMELSEITRWWKQLGLVDKLTFARDRPLECFLWTVGLLPEPKYSGCRIELAKTIAILLVIDDIFDTHGTLDELLLFTNAIKRWDLEAMEDLPEYMRICYMALYNTTNEICYKVLKENGWSVLPYLKATWIDMIEGFMVEAEWFNSDYVPNMEEYVENGVRTAGSYMALVHLFFLIGQGVTEDNVKLLIKPYPKLFSSSGRILRLWDDLGTAKEEQERGDLASSIQLFMREKEIKSEEEGRKGILEIIENLWKELNGELVYREEMPLAIIKTAFNMARASQVVYQHEEDTYFSSVDNYVKALFFTPCFGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFETAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 610 - protein, 1161 aa, Artificial Sequence
  source: /note="Description of Artificial Sequence: Synthetic polypeptide"
MTSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVWGSTSSGTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 611 - protein, 1159 aa, Artificial Sequence
  source: /note="Description of Artificial Sequence: Synthetic polypeptide"
MTSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVWGSTSSGGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIAL

SEQ ID NO: 612 - protein, 1165 aa, Artificial Sequence
  source: /note="Description of Artificial Sequence: Synthetic polypeptide"
MTSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVWGSTSSGSSGGTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 613 - protein, 1163 aa, Artificial Sequence
  source: /note="Description of Artificial Sequence: Synthetic polypeptide"
MTSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVWGSTSSGSSGGGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIAL

SEQ ID NO: 614 - protein, 1170 aa, Artificial Sequence
  source: /note="Description of Artificial Sequence: Synthetic polypeptide"
MTSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVWGGGSGGSTSSGSSGGTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 615 - protein, 1168 aa, Artificial Sequence
  source: /note="Description of Artificial Sequence: Synthetic polypeptide"
MTSALYASDLFKQLKSIMGTDSLSDDVVLVIATTSLALVAGFVVLLWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVWGGGSGGSTSSGSSGGGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIAL

SEQ ID NO: 616 - protein, 1187 aa, Artificial Sequence
  source: /note="Description of Artificial Sequence: Synthetic polypeptide"
MDSSSEKLSPFELMSAILKGAKLDGSNSSDSGVAVSPAVMAMLLENKELVMILTTSVAVLIGCVVVLIWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 617 - protein, 1185 aa, Artificial Sequence
  source: /note="Description of Artificial Sequence: Synthetic polypeptide"
MDSSSEKLSPFELMSAILKGAKLDGSNSSDSGVAVSPAVMAMLLENKELVMILTTSVAVLIGCVVVLIWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIAL

SEQ ID NO: 618 - protein, 1191 aa, Artificial Sequence
  source: /note="Description of Artificial Sequence: Synthetic polypeptide"
MDSSSEKLSPFELMSAILKGAKLDGSNSSDSGVAVSPAVMAMLLENKELVMILTTSVAVLIGCVVVLIWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGSSGGTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 619 - protein, 1189 aa, Artificial Sequence
  source: /note="Description of Artificial Sequence: Synthetic polypeptide"
MDSSSEKLSPFELMSAILKGAKLDGSNSSDSGVAVSPAVMAMLLENKELVMILTTSVAVLIGCVVVLIWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGSSGGGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIAL

SEQ ID NO: 620 - protein, 1196 aa, Artificial Sequence
  source: /note="Description of Artificial Sequence: Synthetic polypeptide"
MDSSSEKLSPFELMSAILKGAKLDGSNSSDSGVAVSPAVMAMLLENKELVMILTTSVAVLIGCVVVLIWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGGGSGGSTSSGSSGGTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTL

SEQ ID NO: 621 - protein, 1194 aa, Artificial Sequence
  source: /note="Description of Artificial Sequence: Synthetic polypeptide"
MDSSSEKLSPFELMSAILKGAKLDGSNSSDSGVAVSPAVMAMLLENKELVMILTTSVAVLIGCVVVLIWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGGGSGGSTSSGSSGGGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIAL

SEQ ID NO: 622 - protein, 1141 aa, Artificial Sequence
  source: /note="Description of Artificial Sequence: Synthetic polypeptide"
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTLGSTSSGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 623 - protein, 1145 aa, Artificial Sequence
  source: /note="Description of Artificial Sequence: Synthetic polypeptide"
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTLGSTSSGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 624 - protein, 1145 aa, Artificial Sequence
  source: /note="Description of Artificial Sequence: Synthetic polypeptide"
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTLGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 625 - protein, 1149 aa, Artificial Sequence
  source: /note="Description of Artificial Sequence: Synthetic polypeptide"
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTLGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 626 - protein, 1150 aa, Artificial Sequence
  source: /note="Description of Artificial Sequence: Synthetic polypeptide"
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTLGGGSGGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 627 - protein, 1154 aa, Artificial Sequence
  source: /note="Description of Artificial Sequence: Synthetic polypeptide"
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTLGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 628 - protein, 1140 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGSTSSGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 629 - protein, 1144 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGSTSSGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 630 - protein, 1144 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 631 - protein, 1148 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 632 - protein, 1149 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 633 - protein, 1153 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 634 - protein, 1141 aa, Artificial Sequence
  source: /note="Description of Artificial Sequence: Synthetic polypeptide"
MALLLAVFRLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 635 - protein, 1136 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 636 - protein, 1139 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 637 - protein, 1117 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 638 - protein, 1151 aa, Artificial Sequence
  source: /note="Description of Artificial Sequence: Synthetic polypeptide"
MDFLTIVLGLLFTLVLVHGLQTLSARAKKLPPGPTPLPLIGSLHLLGDQPHQSLAKLAKTHGPLMCLRLGFINTVVVSSAAMAKEVLQKQDLVFSSRTIPDAIHAHDQFKYSVVWLPVASRWRSLRKVLNSNIFSGSRLDANQHLRCRKVQELIAYCRKNSQTGEPVDVGRAAFRTSLNLLSNTIFSKDLTDPFSDSAKEFKDLVWNIMVEAGKPNLVDFFPMLEKLDPQGIRRRMTIHFGKVIDLFSGLINERLEKGKTQNAGNSDVIDILLATSKENPEEIDRVHIERMCLDLFVAGTDTTSSTLEWAMAEALKNPETVKKAKAELEEVIGKGKVLDEADISRLPYLRCMVKETLRIHPPVPFLIPRRVDQDVEVCGYTVPKNSQVFVNAWAIGRDPDVWKDPLEFKPERFLESELDMRGRDFELIPFGAGRRICPGLPLAVRMVPVMLGSLLNSFDWKLENGIGPKELDMDEKFGITLQKARPLRAVPLPLGGGSGGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 639 - protein, 1155 aa, Artificial Sequence
  source: /note="Description of Artificial Sequence: Synthetic polypeptide"
MDFLTIVLGLLFTLVLVHGLQTLSARAKKLPPGPTPLPLIGSLHLLGDQPHQSLAKLAKTHGPLMCLRLGFINTVVVSSAAMAKEVLQKQDLVFSSRTIPDAIHAHDQFKYSVVWLPVASRWRSLRKVLNSNIFSGSRLDANQHLRCRKVQELIAYCRKNSQTGEPVDVGRAAFRTSLNLLSNTIFSKDLTDPFSDSAKEFKDLVWNIMVEAGKPNLVDFFPMLEKLDPQGIRRRMTIHFGKVIDLFSGLINERLEKGKTQNAGNSDVIDILLATSKENPEEIDRVHIERMCLDLFVAGTDTTSSTLEWAMAEALKNPETVKKAKAELEEVIGKGKVLDEADISRLPYLRCMVKETLRIHPPVPFLIPRRVDQDVEVCGYTVPKNSQVFVNAWAIGRDPDVWKDPLEFKPERFLESELDMRGRDFELIPFGAGRRICPGLPLAVRMVPVMLGSLLNSFDWKLENGIGPKELDMDEKFGITLQKARPLRAVPLPLGGGSGGSTSSGSSGGWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 640 - protein, 1155 aa, Artificial Sequence
  source: /note="Description of Artificial Sequence: Synthetic polypeptide"
MDFLTIVLGLLFTLVLVHGLQTLSARAKKLPPGPTPLPLIGSLHLLGDQPHQSLAKLAKTHGPLMCLRLGFINTVVVSSAAMAKEVLQKQDLVFSSRTIPDAIHAHDQFKYSVVWLPVASRWRSLRKVLNSNIFSGSRLDANQHLRCRKVQELIAYCRKNSQTGEPVDVGRAAFRTSLNLLSNTIFSKDLTDPFSDSAKEFKDLVWNIMVEAGKPNLVDFFPMLEKLDPQGIRRRMTIHFGKVIDLFSGLINERLEKGKTQNAGNSDVIDILLATSKENPEEIDRVHIERMCLDLFVAGTDTTSSTLEWAMAEALKNPETVKKAKAELEEVIGKGKVLDEADISRLPYLRCMVKETLRIHPPVPFLIPRRVDQDVEVCGYTVPKNSQVFVNAWAIGRDPDVWKDPLEFKPERFLESELDMRGRDFELIPFGAGRRICPGLPLAVRMVPVMLGSLLNSFDWKLENGIGPKELDMDEKFGITLQKARPLRAVPLPLGGGSGGSTSSGSSGGWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 641 - protein, 1155 aa, Artificial Sequence
  source: /note="Description of Artificial Sequence: Synthetic polypeptide"
MDFLTIVLGLLFTLVLVHGLQTLSARAKKLPPGPTPLPLIGSLHLLGDQPHQSLAKLAKTHGPLMCLRLGFINTVVVSSAAMAKEVLQKQDLVFSSRTIPDAIHAHDQFKYSVVWLPVASRWRSLRKVLNSNIFSGSRLDANQHLRCRKVQELIAYCRKNSQTGEPVDVGRAAFRTSLNLLSNTIFSKDLTDPFSDSAKEFKDLVWNIMVEAGKPNLVDFFPMLEKLDPQGIRRRMTIHFGKVIDLFSGLINERLEKGKTQNAGNSDVIDILLATSKENPEEIDRVHIERMCLDLFVAGTDTTSSTLEWAMAEALKNPETVKKAKAELEEVIGKGKVLDEADISRLPYLRCMVKETLRIHPPVPFLIPRRVDQDVEVCGYTVPKNSQVFVNAWAIGRDPDVWKDPLEFKPERFLESELDMRGRDFELIPFGAGRRICPGLPLAVRMVPVMLGSLLNSFDWKLENGIGPKELDMDEKFGITLQKARPLRAVPLPLGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 642 - protein, 1150 aa, Artificial Sequence
  source: /note="Description of Artificial Sequence: Synthetic polypeptide"
MDYLTIALGFLFALTLYQALISFSRKSKNLPPGPAPLPFIGNLHLLGDQPHKSLAKLAKKHGPIMGLQFGQVTTIVVTSSGMAKEVLQKQDLAFSSRSVPNALHAHDQYKYSVIWLPVASQWRSLRKVLNSNIFSGNRLDANQHLRCRKVQELIAYCRKNCQTGEAVDLGRAAFRTSLNLLSNTIFSKDLTDPYSDSAKEFKDLVWNVMVEAGKPNLVDFFPVLDKVDPQGIRKRMTFHFGKILQLFGGLINERLQQNKAKGAHKDVLDVLLKTSQETPDELNRTHIERMCLDLFVAGTDTTSSTLEWAMAEMLKSPDKMNKAKEELAQVIGKGKAVEEADIASLPYLRCAIKETLRIHPPVPFLIPRRTEQEVEVCGYTVPKNSQVFVNVWAIGRDETTWPDALEFKPERFLESEIDMRGRDFELLPFGAGRRICPGFPLAVRMVPVMLGSLLNSFDWKLEGGIAPKDLDMEEKFGITLQKAHPLRAIPTSLGGGSGGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 643 - protein, 1154 aa, Artificial Sequence
  source: /note="Description of Artificial Sequence: Synthetic polypeptide"
MDYLTIALGFLFALTLYQALISFSRKSKNLPPGPAPLPFIGNLHLLGDQPHKSLAKLAKKHGPIMGLQFGQVTTIVVTSSGMAKEVLQKQDLAFSSRSVPNALHAHDQYKYSVIWLPVASQWRSLRKVLNSNIFSGNRLDANQHLRCRKVQELIAYCRKNCQTGEAVDLGRAAFRTSLNLLSNTIFSKDLTDPYSDSAKEFKDLVWNVMVEAGKPNLVDFFPVLDKVDPQGIRKRMTFHFGKILQLFGGLINERLQQNKAKGAHKDVLDVLLKTSQETPDELNRTHIERMCLDLFVAGTDTTSSTLEWAMAEMLKSPDKMNKAKEELAQVIGKGKAVEEADIASLPYLRCAIKETLRIHPPVPFLIPRRTEQEVEVCGYTVPKNSQVFVNVWAIGRDETTWPDALEFKPERFLESEIDMRGRDFELLPFGAGRRICPGFPLAVRMVPVMLGSLLNSFDWKLEGGIAPKDLDMEEKFGITLQKAHPLRAIPTSLGGGSGGSTSSGSSGGWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 644 - protein, 1154 aa, Artificial Sequence
  source: /note="Description of Artificial Sequence: Synthetic polypeptide"
MDYLTIALGFLFALTLYQALISFSRKSKNLPPGPAPLPFIGNLHLLGDQPHKSLAKLAKKHGPIMGLQFGQVTTIVVTSSGMAKEVLQKQDLAFSSRSVPNALHAHDQYKYSVIWLPVASQWRSLRKVLNSNIFSGNRLDANQHLRCRKVQELIAYCRKNCQTGEAVDLGRAAFRTSLNLLSNTIFSKDLTDPYSDSAKEFKDLVWNVMVEAGKPNLVDFFPVLDKVDPQGIRKRMTFHFGKILQLFGGLINERLQQNKAKGAHKDVLDVLLKTSQETPDELNRTHIERMCLDLFVAGTDTTSSTLEWAMAEMLKSPDKMNKAKEELAQVIGKGKAVEEADIASLPYLRCAIKETLRIHPPVPFLIPRRTEQEVEVCGYTVPKNSQVFVNVWAIGRDETTWPDALEFKPERFLESEIDMRGRDFELLPFGAGRRICPGFPLAVRMVPVMLGSLLNSFDWKLEGGIAPKDLDMEEKFGITLQKAHPLRAIPTSLGGGSGGSTSSGSSGGWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 645 - protein, 1154 aa, Artificial Sequence
  source: /note="Description of Artificial Sequence: Synthetic polypeptide"
MDYLTIALGFLFALTLYQALISFSRKSKNLPPGPAPLPFIGNLHLLGDQPHKSLAKLAKKHGPIMGLQFGQVTTIVVTSSGMAKEVLQKQDLAFSSRSVPNALHAHDQYKYSVIWLPVASQWRSLRKVLNSNIFSGNRLDANQHLRCRKVQELIAYCRKNCQTGEAVDLGRAAFRTSLNLLSNTIFSKDLTDPYSDSAKEFKDLVWNVMVEAGKPNLVDFFPVLDKVDPQGIRKRMTFHFGKILQLFGGLINERLQQNKAKGAHKDVLDVLLKTSQETPDELNRTHIERMCLDLFVAGTDTTSSTLEWAMAEMLKSPDKMNKAKEELAQVIGKGKAVEEADIASLPYLRCAIKETLRIHPPVPFLIPRRTEQEVEVCGYTVPKNSQVFVNVWAIGRDETTWPDALEFKPERFLESEIDMRGRDFELLPFGAGRRICPGFPLAVRMVPVMLGSLLNSFDWKLEGGIAPKDLDMEEKFGITLQKAHPLRAIPTSLGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 646 - protein, 1150 aa, Artificial Sequence
  source: /note="Description of Artificial Sequence: Synthetic polypeptide"
MDYLTITLGLLFALTFYQGLSYLSRRSKKLPPGPAPLPIIGNLHMLGDQPHKSLAKLSKKHGPIMSLKLGQITTVVVSSSGMAKEVLQKHDLAFSSRSIPNALHAHNQYQFSVVWLPVASRWRSLRKTLNSNIFSGNRLDANQHLRSRKVEELIAYCRKNCQTGEAVDVGRAAFRTSLNLLSNLIFSKDLTDPYSDSAKEFKDLVWNIMVEAGKPNLVDYFPVLEKVDPQGIRRRMTVHFGKVLKLFDGLVNERLEQRRSRGGKNDVLDVLLTNSEENPEEIDRTHIERMCLDLFVAGTDTTSSTLEWAMAEMLKNPDKMKKTQAELAEVIGRGKAIEESDLPRLPYLRCVVKETLRIHPPVPFLIPRRVEQDVEVCGYKVPKGSQVLVNAWTIGRDEAVWEDALAFKPERFLESELDIRGRDFELIPFGAGRRICPGLPLALRTVPLMVGSLLNSFNWKLEGGITPKDLDMEEKFGITLQKAHPLRAVPIPFGGGSGGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 647 - protein, 1154 aa, Artificial Sequence
  source: /note="Description of Artificial Sequence: Synthetic polypeptide"
MDYLTITLGLLFALTFYQGLSYLSRRSKKLPPGPAPLPIIGNLHMLGDQPHKSLAKLSKKHGPIMSLKLGQITTVVVSSSGMAKEVLQKHDLAFSSRSIPNALHAHNQYQFSVVWLPVASRWRSLRKTLNSNIFSGNRLDANQHLRSRKVEELIAYCRKNCQTGEAVDVGRAAFRTSLNLLSNLIFSKDLTDPYSDSAKEFKDLVWNIMVEAGKPNLVDYFPVLEKVDPQGIRRRMTVHFGKVLKLFDGLVNERLEQRRSRGGKNDVLDVLLTNSEENPEEIDRTHIERMCLDLFVAGTDTTSSTLEWAMAEMLKNPDKMKKTQAELAEVIGRGKAIEESDLPRLPYLRCVVKETLRIHPPVPFLIPRRVEQDVEVCGYKVPKGSQVLVNAWTIGRDEAVWEDALAFKPERFLESELDIRGRDFELIPFGAGRRICPGLPLALRTVPLMVGSLLNSFNWKLEGGITPKDLDMEEKFGITLQKAHPLRAVPIPFGGGSGGSTSSGSSGGWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 648 - protein, 1154 aa, Artificial Sequence
  source: /note="Description of Artificial Sequence: Synthetic polypeptide"
MDYLTITLGLLFALTFYQGLSYLSRRSKKLPPGPAPLPIIGNLHMLGDQPHKSLAKLSKKHGPIMSLKLGQITTVVVSSSGMAKEVLQKHDLAFSSRSIPNALHAHNQYQFSVVWLPVASRWRSLRKTLNSNIFSGNRLDANQHLRSRKVEELIAYCRKNCQTGEAVDVGRAAFRTSLNLLSNLIFSKDLTDPYSDSAKEFKDLVWNIMVEAGKPNLVDYFPVLEKVDPQGIRRRMTVHFGKVLKLFDGLVNERLEQRRSRGGKNDVLDVLLTNSEENPEEIDRTHIERMCLDLFVAGTDTTSSTLEWAMAEMLKNPDKMKKTQAELAEVIGRGKAIEESDLPRLPYLRCVVKETLRIHPPVPFLIPRRVEQDVEVCGYKVPKGSQVLVNAWTIGRDEAVWEDALAFKPERFLESELDIRGRDFELIPFGAGRRICPGLPLALRTVPLMVGSLLNSFNWKLEGGITPKDLDMEEKFGITLQKAHPLRAVPIPFGGGSGGSTSSGSSGGWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 649 - protein, 1154 aa, Artificial Sequence
  source: /note="Description of Artificial Sequence: Synthetic polypeptide"
MDYLTITLGLLFALTFYQGLSYLSRRSKKLPPGPAPLPIIGNLHMLGDQPHKSLAKLSKKHGPIMSLKLGQITTVVVSSSGMAKEVLQKHDLAFSSRSIPNALHAHNQYQFSVVWLPVASRWRSLRKTLNSNIFSGNRLDANQHLRSRKVEELIAYCRKNCQTGEAVDVGRAAFRTSLNLLSNLIFSKDLTDPYSDSAKEFKDLVWNIMVEAGKPNLVDYFPVLEKVDPQGIRRRMTVHFGKVLKLFDGLVNERLEQRRSRGGKNDVLDVLLTNSEENPEEIDRTHIERMCLDLFVAGTDTTSSTLEWAMAEMLKNPDKMKKTQAELAEVIGRGKAIEESDLPRLPYLRCVVKETLRIHPPVPFLIPRRVEQDVEVCGYKVPKGSQVLVNAWTIGRDEAVWEDALAFKPERFLESELDIRGRDFELIPFGAGRRICPGLPLALRTVPLMVGSLLNSFNWKLEGGITPKDLDMEEKFGITLQKAHPLRAVPIPFGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 650 - protein, 1150 aa, Artificial Sequence
  source: /note="Description of Artificial Sequence: Synthetic polypeptide"
MDYLTLVLGLLFALTFYQGLSYLSRKSKKLPPGPAPLPFIGNLHLLGDQPHKSLAKLSKKHGPLMSLKLGHITTVVISSSGMAKEVLQKQDLAFSSRSVPDALHAHNQFQFSVVWLPVASRWRSLRKILNSNIFSGNRLDANQHLRCRKVQELIAYCRKNCQTGEAVDVGRAAFRTSLNLLSNTIFSKDLTDPYSDSAKEFKDLVWNIMVEAGKPNLVDFFPVLEKVDPQGIRKRMTVHFGKVLKLFNGLINERLEQKRLQSGNNDVLDVLLTTSEESPEEIDRTHIERMCLDLFVAGTDTTSSTLEWAMAEMLKNPDKMQKTQAEIAEVIGKGKAIEEADVARLPYLRCVVKETLRIHPPVPFLIPRKVDQDVEVCGYKVPKGSQVLVNAWAIGRDGTVWEDPLAFKPERFFESEIDIRGRDFEVIPFGAGRRICPGLPLAARMVPVMLGSLLNSFNWKLEGGIAPKDLDMDEKFGITLQKAHPLRAVPSPLGGGSGGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 651 - protein, 1154 aa, Artificial Sequence
  source: /note="Description of Artificial Sequence: Synthetic polypeptide"
MDYLTLVLGLLFALTFYQGLSYLSRKSKKLPPGPAPLPFIGNLHLLGDQPHKSLAKLSKKHGPLMSLKLGHITTVVISSSGMAKEVLQKQDLAFSSRSVPDALHAHNQFQFSVVWLPVASRWRSLRKILNSNIFSGNRLDANQHLRCRKVQELIAYCRKNCQTGEAVDVGRAAFRTSLNLLSNTIFSKDLTDPYSDSAKEFKDLVWNIMVEAGKPNLVDFFPVLEKVDPQGIRKRMTVHFGKVLKLFNGLINERLEQKRLQSGNNDVLDVLLTTSEESPEEIDRTHIERMCLDLFVAGTDTTSSTLEWAMAEMLKNPDKMQKTQAEIAEVIGKGKAIEEADVARLPYLRCVVKETLRIHPPVPFLIPRKVDQDVEVCGYKVPKGSQVLVNAWAIGRDGTVWEDPLAFKPERFFESEIDIRGRDFEVIPFGAGRRICPGLPLAARMVPVMLGSLLNSFNWKLEGGIAPKDLDMDEKFGITLQKAHPLRAVPSPLGGGSGGSTSSGSSGGWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 652 - protein, 1154 aa, Artificial Sequence
  source: /note="Description of Artificial Sequence: Synthetic polypeptide"
MDYLTLVLGLLFALTFYQGLSYLSRKSKKLPPGPAPLPFIGNLHLLGDQPHKSLAKLSKKHGPLMSLKLGHITTVVISSSGMAKEVLQKQDLAFSSRSVPDALHAHNQFQFSVVWLPVASRWRSLRKILNSNIFSGNRLDANQHLRCRKVQELIAYCRKNCQTGEAVDVGRAAFRTSLNLLSNTIFSKDLTDPYSDSAKEFKDLVWNIMVEAGKPNLVDFFPVLEKVDPQGIRKRMTVHFGKVLKLFNGLINERLEQKRLQSGNNDVLDVLLTTSEESPEEIDRTHIERMCLDLFVAGTDTTSSTLEWAMAEMLKNPDKMQKTQAEIAEVIGKGKAIEEADVARLPYLRCVVKETLRIHPPVPFLIPRKVDQDVEVCGYKVPKGSQVLVNAWAIGRDGTVWEDPLAFKPERFFESEIDIRGRDFEVIPFGAGRRICPGLPLAARMVPVMLGSLLNSFNWKLEGGIAPKDLDMDEKFGITLQKAHPLRAVPSPLGGGSGGSTSSGSSGGWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 653 - protein, 1154 aa, Artificial Sequence
  source: /note="Description of Artificial Sequence: Synthetic polypeptide"
MDYLTLVLGLLFALTFYQGLSYLSRKSKKLPPGPAPLPFIGNLHLLGDQPHKSLAKLSKKHGPLMSLKLGHITTVVISSSGMAKEVLQKQDLAFSSRSVPDALHAHNQFQFSVVWLPVASRWRSLRKILNSNIFSGNRLDANQHLRCRKVQELIAYCRKNCQTGEAVDVGRAAFRTSLNLLSNTIFSKDLTDPYSDSAKEFKDLVWNIMVEAGKPNLVDFFPVLEKVDPQGIRKRMTVHFGKVLKLFNGLINERLEQKRLQSGNNDVLDVLLTTSEESPEEIDRTHIERMCLDLFVAGTDTTSSTLEWAMAEMLKNPDKMQKTQAEIAEVIGKGKAIEEADVARLPYLRCVVKETLRIHPPVPFLIPRKVDQDVEVCGYKVPKGSQVLVNAWAIGRDGTVWEDPLAFKPERFFESEIDIRGRDFEVIPFGAGRRICPGLPLAARMVPVMLGSLLNSFNWKLEGGIAPKDLDMDEKFGITLQKAHPLRAVPSPLGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 654 - protein, 1150 aa, Artificial Sequence; identical to SEQ ID NO: 626
  source: /note="Description of Artificial Sequence: Synthetic polypeptide"

SEQ ID NO: 655 - protein, 1154 aa, Artificial Sequence
  source: /note="Description of Artificial Sequence: Synthetic polypeptide"
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTLGGGSGGSTSSGSSGGWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 656 - protein, 1154 aa, Artificial Sequence
  source: /note="Description of Artificial Sequence: Synthetic polypeptide"
MDYLTIILTLLFALTLYEAFSYLSRRTKNLPPGPSPLPFIGSLHLLGDQPHKSLAKLSKKHGPIMSLKLGQITTIVISSSTMAKEVLQKQDLAFSSRSVPNALHAHNQFKFSVVWLPVASRWRSLRKVLNSNIFSGNRLDANQHLRTRKVQELIAYCRKNSQSGEAVDVGRAAFRTSLNLLSNLIFSKDLTDPYSDSAKEFKDLVWNIMVEAGKPNLVDFFPLLEKVDPQGIRHRMTIHFGEVLKLFGGLVNERLEQRRSKGEKNDVLDVLLTTSQESPEEIDRTHIERMCLDLFVAGTDTTSSTLEWAMSEMLKNPDKMKKTQDELAQVIGRGKTIEESDINRLPYLRCVMKETLRIHPPVPFLIPRKVEQSVEVCGYNVPKGSQVLVNAWAIGRDETVWDDALAFKPERFMESELDIRGRDFELIPFGAGRRICPGLPLALRTVPLMLGSLLNSFNWKLEGGMAPKDLDMEEKFGITLQKAHPLRAVPSTLGGGSGGSTSSGSSGGWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 657 - protein, 1154 aa, Artificial Sequence; identical to SEQ ID NO: 627
  source: /note="Description of Artificial Sequence: Synthetic polypeptide"

SEQ ID NO: 658 - protein, 1149 aa, Artificial Sequence; identical to SEQ ID NO: 632
  source: /note="Description of Artificial Sequence: Synthetic polypeptide"

SEQ ID NO: 659 - protein, 1153 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 660 - protein, 1153 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 661 - protein, 1153 aa, Artificial Sequence; identical to SEQ ID NO: 633
  source: /note="Description of Artificial Sequence: Synthetic polypeptide"

SEQ ID NO: 662 - protein, 1155 aa, Artificial Sequence
  source: /note="Description of Artificial Sequence: Synthetic polypeptide"
MDFFSFLLYFLFTLSLVQATISLVRGSKHKGRKLPPGPAPLPIVGNLLKLGDQPHKSLADLAKIHGPIMTLKLGHITTVIISSSDLAKEVLQKQDLAFSSRSIPDAIRAHNQFQYSVVWLPVANQWRSLRKILNSNIFSGNRLDANQHLRWRKVQELIAYVRKSSQVGDAVDIGRAAFRTSLNLLSNTIFSVDLADPNNDSAKEFKDLVSNIMVEAGKPNLVDYFPVLEKIDPQGIRRRMTIHFGKVLEMFGRLINERLEFRRLRSSVISNDVLDVLLNTEESGNEIDRNHIERMCLDLFVAGTDTTSSTLEWAMAEVLHNPETLVKAKAELEQIIGRGKAIEESDISNLPYLRSIIKETLRLHPPVPFLIPRKVEVDSEVSGYTVPKGSQVLVNAWAIGRDPCCWENPLNFSPERFLNSELDVRGRDFELIPFGAGRRICPGLPLAIRMVPVMLGSLLNSFDWKLDGGIKPEELDMEEKFGITLQKAQPLRAVPTLVGGGSGGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 663 - protein, 1159 aa, Artificial Sequence
  source: /note="Description of Artificial Sequence: Synthetic polypeptide"
MDFFSFLLYFLFTLSLVQATISLVRGSKHKGRKLPPGPAPLPIVGNLLKLGDQPHKSLADLAKIHGPIMTLKLGHITTVIISSSDLAKEVLQKQDLAFSSRSIPDAIRAHNQFQYSVVWLPVANQWRSLRKILNSNIFSGNRLDANQHLRWRKVQELIAYVRKSSQVGDAVDIGRAAFRTSLNLLSNTIFSVDLADPNNDSAKEFKDLVSNIMVEAGKPNLVDYFPVLEKIDPQGIRRRMTIHFGKVLEMFGRLINERLEFRRLRSSVISNDVLDVLLNTEESGNEIDRNHIERMCLDLFVAGTDTTSSTLEWAMAEVLHNPETLVKAKAELEQIIGRGKAIEESDISNLPYLRSIIKETLRLHPPVPFLIPRKVEVDSEVSGYTVPKGSQVLVNAWAIGRDPCCWENPLNFSPERFLNSELDVRGRDFELIPFGAGRRICPGLPLAIRMVPVMLGSLLNSFDWKLDGGIKPEELDMEEKFGITLQKAQPLRAVPTLVGGGSGGSTSSGSSGGWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 664 - protein, 1159 aa, Artificial Sequence
  source: /note="Description of Artificial Sequence: Synthetic polypeptide"
MDFFSFLLYFLFTLSLVQATISLVRGSKHKGRKLPPGPAPLPIVGNLLKLGDQPHKSLADLAKIHGPIMTLKLGHITTVIISSSDLAKEVLQKQDLAFSSRSIPDAIRAHNQFQYSVVWLPVANQWRSLRKILNSNIFSGNRLDANQHLRWRKVQELIAYVRKSSQVGDAVDIGRAAFRTSLNLLSNTIFSVDLADPNNDSAKEFKDLVSNIMVEAGKPNLVDYFPVLEKIDPQGIRRRMTIHFGKVLEMFGRLINERLEFRRLRSSVISNDVLDVLLNTEESGNEIDRNHIERMCLDLFVAGTDTTSSTLEWAMAEVLHNPETLVKAKAELEQIIGRGKAIEESDISNLPYLRSIIKETLRLHPPVPFLIPRKVEVDSEVSGYTVPKGSQVLVNAWAIGRDPCCWENPLNFSPERFLNSELDVRGRDFELIPFGAGRRICPGLPLAIRMVPVMLGSLLNSFDWKLDGGIKPEELDMEEKFGITLQKAQPLRAVPTLVGGGSGGSTSSGSSGGWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 665 - protein, 1159 aa, Artificial Sequence
  source: /note="Description of Artificial Sequence: Synthetic polypeptide"
MDFFSFLLYFLFTLSLVQATISLVRGSKHKGRKLPPGPAPLPIVGNLLKLGDQPHKSLADLAKIHGPIMTLKLGHITTVIISSSDLAKEVLQKQDLAFSSRSIPDAIRAHNQFQYSVVWLPVANQWRSLRKILNSNIFSGNRLDANQHLRWRKVQELIAYVRKSSQVGDAVDIGRAAFRTSLNLLSNTIFSVDLADPNNDSAKEFKDLVSNIMVEAGKPNLVDYFPVLEKIDPQGIRRRMTIHFGKVLEMFGRLINERLEFRRLRSSVISNDVLDVLLNTEESGNEIDRNHIERMCLDLFVAGTDTTSSTLEWAMAEVLHNPETLVKAKAELEQIIGRGKAIEESDISNLPYLRSIIKETLRLHPPVPFLIPRKVEVDSEVSGYTVPKGSQVLVNAWAIGRDPCCWENPLNFSPERFLNSELDVRGRDFELIPFGAGRRICPGLPLAIRMVPVMLGSLLNSFDWKLDGGIKPEELDMEEKFGITLQKAQPLRAVPTLVGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 666 - protein, 1150 aa, Artificial Sequence
  source: /note="Description of Artificial Sequence: Synthetic polypeptide"
MDYLTIALGLLFALTFYQGLTYLSRRSQKLPPGPLPLPIIGNLHLLGDHPHKSLAKLSKKYGPIMSLKLGRITTLVISSSTTAKEVLQKQDLAFSSRSVPNALHAHNQFQYSVVWLPVASRWRSLRKILNSNIFSGNRLDANQHLRCRKVEELIAYCRKNCQSGEAVDLGRAAFRTSLNLLSNTIFSKDLTDPYSDSAKEFKDLVWNIMVEAGKPNLVDFFPVLEKVDPQGIRRRMTVHFGKVIQLFNGLINERLDKRKSRGGYNDVLDVLLTTTEENPEEIDRTHIERMCLDLFVAGTDTTSSTLEWAMAEMLRNPEKMKKTQEELAEVVGRGKLIEEGDVSRLPYLRCVVKETLRVHPPVPFLIPRKVVQDVEVCGYKVPKGSQVLVNAWAIGRDETFWKDALGFKPERFLESELDTRGRDFELIPFGAGRRICPGLPLANRMVPVMLGSLLNSFNWKLEGGIAPKDLDMEEKFGITLQKAHPLRAVPSPLGGGSGGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 667 - protein, 1154 aa, Artificial Sequence
  source: /note="Description of Artificial Sequence: Synthetic polypeptide"
MDYLTIALGLLFALTFYQGLTYLSRRSQKLPPGPLPLPIIGNLHLLGDHPHKSLAKLSKKYGPIMSLKLGRITTLVISSSTTAKEVLQKQDLAFSSRSVPNALHAHNQFQYSVVWLPVASRWRSLRKILNSNIFSGNRLDANQHLRCRKVEELIAYCRKNCQSGEAVDLGRAAFRTSLNLLSNTIFSKDLTDPYSDSAKEFKDLVWNIMVEAGKPNLVDFFPVLEKVDPQGIRRRMTVHFGKVIQLFNGLINERLDKRKSRGGYNDVLDVLLTTTEENPEEIDRTHIERMCLDLFVAGTDTTSSTLEWAMAEMLRNPEKMKKTQEELAEVVGRGKLIEEGDVSRLPYLRCVVKETLRVHPPVPFLIPRKVVQDVEVCGYKVPKGSQVLVNAWAIGRDETFWKDALGFKPERFLESELDTRGRDFELIPFGAGRRICPGLPLANRMVPVMLGSLLNSFNWKLEGGIAPKDLDMEEKFGITLQKAHPLRAVPSPLGGGSGGSTSSGSSGGWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 668 - protein, 1154 aa, Artificial Sequence
  source: /note="Description of Artificial Sequence: Synthetic polypeptide"
MDYLTIALGLLFALTFYQGLTYLSRRSQKLPPGPLPLPIIGNLHLLGDHPHKSLAKLSKKYGPIMSLKLGRITTLVISSSTTAKEVLQKQDLAFSSRSVPNALHAHNQFQYSVVWLPVASRWRSLRKILNSNIFSGNRLDANQHLRCRKVEELIAYCRKNCQSGEAVDLGRAAFRTSLNLLSNTIFSKDLTDPYSDSAKEFKDLVWNIMVEAGKPNLVDFFPVLEKVDPQGIRRRMTVHFGKVIQLFNGLINERLDKRKSRGGYNDVLDVLLTTTEENPEEIDRTHIERMCLDLFVAGTDTTSSTLEWAMAEMLRNPEKMKKTQEELAEVVGRGKLIEEGDVSRLPYLRCVVKETLRVHPPVPFLIPRKVVQDVEVCGYKVPKGSQVLVNAWAIGRDETFWKDALGFKPERFLESELDTRGRDFELIPFGAGRRICPGLPLANRMVPVMLGSLLNSFNWKLEGGIAPKDLDMEEKFGITLQKAHPLRAVPSPLGGGSGGSTSSGSSGGWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 669 - protein, 1154 aa, Artificial Sequence
  source: /note="Description of Artificial Sequence: Synthetic polypeptide"
MDYLTIALGLLFALTFYQGLTYLSRRSQKLPPGPLPLPIIGNLHLLGDHPHKSLAKLSKKYGPIMSLKLGRITTLVISSSTTAKEVLQKQDLAFSSRSVPNALHAHNQFQYSVVWLPVASRWRSLRKILNSNIFSGNRLDANQHLRCRKVEELIAYCRKNCQSGEAVDLGRAAFRTSLNLLSNTIFSKDLTDPYSDSAKEFKDLVWNIMVEAGKPNLVDFFPVLEKVDPQGIRRRMTVHFGKVIQLFNGLINERLDKRKSRGGYNDVLDVLLTTTEENPEEIDRTHIERMCLDLFVAGTDTTSSTLEWAMAEMLRNPEKMKKTQEELAEVVGRGKLIEEGDVSRLPYLRCVVKETLRVHPPVPFLIPRKVVQDVEVCGYKVPKGSQVLVNAWAIGRDETFWKDALGFKPERFLESELDTRGRDFELIPFGAGRRICPGLPLANRMVPVMLGSLLNSFNWKLEGGIAPKDLDMEEKFGITLQKAHPLRAVPSPLGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 670 - protein, 1155 aa, Artificial Sequence
  source: /note="Description of Artificial Sequence: Synthetic polypeptide"
MDFFTIALSLLFAFTLFKAIISLTKSGKNKNLPPGPAPLPIIGSLHKLGDQPHQSLAKLAKIYGPIMSLKLGRITTVVISSSDAAKEVLQKKDLAFSSRHVPDALHAHNQFKFSVVWLPVAPQWRSLRKILNSNIFSGNRLDANQHLRCRKVEELITYCRKSSHSGDAVDIGRAAFRTSLNLLSNTIFSKDLTDPYQDSAKEFKELVGNIMVEAGKPNLVDFFPSLKKIDPQGIRHRMTIHFGKVLELFGGLINERLELKSSQKSDEKNDVLDVCLSISKENPDEIDRTHIERMCLDLFVAGTDTTSSTLEWAMAEVLRNPETLVKAKAELEEVIGKGKILAEADVSNLPYLRCIVKETLRIHPPVPFLIPRKVEMDVEACGYTVPKNSQVFVNVWAIGRDPTLWEDPLSFKPERFMASELDVRGRDFELLPFGAGRRICPGLPLAIRMVPVMLGSLVNSFNWKLDGGIAPKELDMGEKFGITLAKAQSLRAVPSPLVGGGSGGSTSSGSSGGWKKTTADRSGELKPLMIPKSLMAKDEDDDLDLGSGKTRVSIFFGTQTGTAEGFAKALSEEIKARYEKAAVKDDYAADDDQYEEKLKKETLAFFCVATYGDGEPTDNAARFYKWFTEENERDIKLQQLAYGVFALGNRQYEHFNKIGIVLDEELCKKGAKRLIEVGLGDDDQSIEDDFNAWKESLWSELDKLLKDEDDKSVATPYTAVIPEYRVVTHDPRFTTQKSMESNVANGNTTIDIHHPCRVDVAVQKELHTHESDRSCIHLEFDISRTGITYETGDHVGVYAENHVEIVEEAGKLLGHSLDLVFSIHADKEDGSPLESAVPPPFPGPCTLGTGLARYADLLNPPRKSALVALAAYATEPSEAEKLKHLTSPDGKDEYSQWIVASQRSLLEVMAAFPSAKPPLGVFFAAIAPRLQPRYYSISSSPRLAPSRVHVTSALVYGPTPTGRIHKGVCSTWMKNAVPAEKSHECSGAPIFIRASNFKLPSNPSTPIVMVGPGTGLAPFRGFLQERMALKEDGEELGSSLLFFGCRNRQMDFIYEDELNNFVDQGVISELIMAFSREGAQKEYVQHKMMEKAAQVWDLIKEEGYLYVCGDAKGMARDVHRTLHTIVQEQEGVSSSEAEAIVKKLQTEGRYLRDVW

SEQ ID NO: 671 - protein, 1159 aa, Artificial Sequence
  source: /note="Description of Artificial Sequence: Synthetic polypeptide"
MDFFTIALSLLFAFTLFKAIISLTKSGKNKNLPPGPAPLPIIGSLHKLGDQPHQSLAKLAKIYGPIMSLKLGRITTVVISSSDAAKEVLQKKDLAFSSRHVPDALHAHNQFKFSVVWLPVAPQWRSLRKILNSNIFSGNRLDANQHLRCRKVEELITYCRKSSHSGDAVDIGRAAFRTSLNLLSNTIFSKDLTDPYQDSAKEFKELVGNIMVEAGKPNLVDFFPSLKKIDPQGIRHRMTIHFGKVLELFGGLINERLELKSSQKSDEKNDVLDVCLSISKENPDEIDRTHIERMCLDLFVAGTDTTSSTLEWAMAEVLRNPETLVKAKAELEEVIGKGKILAEADVSNLPYLRCIVKETLRIHPPVPFLIPRKVEMDVEACGYTVPKNSQVFVNVWAIGRDPTLWEDPLSFKPERFMASELDVRGRDFELLPFGAGRRICPGLPLAIRMVPVMLGSLVNSFNWKLDGGIAPKELDMGEKFGITLAKAQSLRAVPSPLVGGGSGGSTSSGSSGGWRRSSDRSKESNPVVVPRPLLVEAEEDEVEVGSGKTKLTIFYGTQTGTAEGFAKALAEEIKARYEKAVVKVVDLDDYADDDEQYEEKLKKETLAFFMVATYGDGEPTDNAARFYKWFTDGKERGLWLQQLKFGVFGLGNRQYEHFNKIGKVLDQDLSEQGGKRLIPVGLGDDDQCIEDDFAAWRELLWPELDQLLRDGDDTNTVSTPYTAVIPEYRVVIYDPTTTSFEDKHLSMANGNASYDIHHPCRVNVAVQRELHKPESDRSCIHLEFDISSTGITYETGDHVGVYADNCDETVEEAARLLGQPLDLLFSIHSDDDNGTPLGGSLPPPFPGPCTLRTALARYADLLNPPRKAALIALAAHAIEPSESEKLKFLSSPQGKDDYSQWVVGSQRSLLEVMAEFPSAKPPLGVFFAAVATRLQPRYYSISSSPRFAPSRVHVTCSLVYGPTSTGRIHKGVCSTWMKNAVPLEKSRNCSWAPIFIRASNFKLPSNPSIPIVMVGPGTGLAPFRGFLQERLALKEDGIQLGPALLFFGCRNRRMDFIYEDELNNFVDRGVLSDLIVAFSREGPQKEYVQHKMMEKAAYIWNLISQEGYLYVCGDAKGMARDVHRTLHTIVQEQENADTSKAESVVKKLQMDGRYLRDVW

SEQ ID NO: 672 - protein, 1159 aa, Artificial Sequence
  source: /note="Description of Artificial Sequence: Synthetic polypeptide"
MDFFTIALSLLFAFTLFKAIISLTKSGKNKNLPPGPAPLPIIGSLHKLGDQPHQSLAKLAKIYGPIMSLKLGRITTVVISSSDAAKEVLQKKDLAFSSRHVPDALHAHNQFKFSVVWLPVAPQWRSLRKILNSNIFSGNRLDANQHLRCRKVEELITYCRKSSHSGDAVDIGRAAFRTSLNLLSNTIFSKDLTDPYQDSAKEFKELVGNIMVEAGKPNLVDFFPSLKKIDPQGIRHRMTIHFGKVLELFGGLINERLELKSSQKSDEKNDVLDVCLSISKENPDEIDRTHIERMCLDLFVAGTDTTSSTLEWAMAEVLRNPETLVKAKAELEEVIGKGKILAEADVSNLPYLRCIVKETLRIHPPVPFLIPRKVEMDVEACGYTVPKNSQVFVNVWAIGRDPTLWEDPLSFKPERFMASELDVRGRDFELLPFGAGRRICPGLPLAIRMVPVMLGSLVNSFNWKLDGGIAPKELDMGEKFGITLAKAQSLRAVPSPLVGGGSGGSTSSGSSGGWRKGAGSAKKVVEPPKLVLPKALSETEEVDDGKKKVTIFFGTQTGTAEGFAKALAEEAKARYPQANFKVVDMDDYAAEDEEYEEKLTKETMAFFFLATYGDGEPTDNAARFYKWFAEGKERGDSFKNLHYGVFGLGNRQYEHFNKIAIVVDNILAEQGGKRLVPVGLGDDDQCIEDDFAAWRENVWPELDNLLRNEDDASTVSTPYTAAVLEYRVEFHDQSDELSLENSLANGHANGNASYDAQHPCRANVAVKRELHTPLSDRSCTHLEFDISGTGLQYETGDHVGVYCENLIETVEEAERLLGLSPQTYFSVHTDKEDGTPLGGSALPPPFPPCTLRTALSRYADLLNAPKKSALTALAAYASDPTEADRLKHLASPAGKEEYAQYVVASQRTLLEVMADFPSAKPPLGVFFAGVAPRLQPRFYSISSSPKIAPFRIHVTCALVYDKTPTGRIHKGICSTWIKNAVPLEESSDCSSAPIFVRNSNFKLPSDANIPIIMIGPGTGLAPFRGFLQERLALKESGAELGPAILFFGCRNRKMDFIYEDELNDFVKAGVVSELIVAFSREGSTKEYVQHKMAQRASDVWKMISDGGYIYVCGDAKGMARDVHRTLHTIAQEQGSMSSSEAEGMVKNLQMTGRYLRDVW

SEQ ID NO: 673 - protein, 1159 aa, Artificial Sequence
  source: /note="Description of Artificial Sequence: Synthetic polypeptide"
MDFFTIALSLLFAFTLFKAIISLTKSGKNKNLPPGPAPLPIIGSLHKLGDQPHQSLAKLAKIYGPIMSLKLGRITTVVISSSDAAKEVLQKKDLAFSSRHVPDALHAHNQFKFSVVWLPVAPQWRSLRKILNSNIFSGNRLDANQHLRCRKVEELITYCRKSSHSGDAVDIGRAAFRTSLNLLSNTIFSKDLTDPYQDSAKEFKELVGNIMVEAGKPNLVDFFPSLKKIDPQGIRHRMTIHFGKVLELFGGLINERLELKSSQKSDEKNDVLDVCLSISKENPDEIDRTHIERMCLDLFVAGTDTTSSTLEWAMAEVLRNPETLVKAKAELEEVIGKGKILAEADVSNLPYLRCIVKETLRIHPPVPFLIPRKVEMDVEACGYTVPKNSQVFVNVWAIGRDPTLWEDPLSFKPERFMASELDVRGRDFELLPFGAGRRICPGLPLAIRMVPVMLGSLVNSFNWKLDGGIAPKELDMGEKFGITLAKAQSLRAVPSPLVGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVW

SEQ ID NO: 674 - protein, 1153 aa, Artificial Sequence; identical to SEQ ID NO: 633
  source: /note="Description of Artificial Sequence: Synthetic polypeptide"

SEQ ID NO: 675 - protein, 1293 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPEFVIKILQFLVPLLILGLAFAVRHYTKEK

SEQ ID NO: 676 - protein, 1270 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPEYTKEK

SEQ ID NO: 677 - protein, 1265 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPE

SEQ ID NO: 678 - protein, 1297 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGMPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQYWFASITVAGLSVVVGYLCIRKKQTT

SEQ ID NO: 679 - protein, 1277 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGMPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQRKKQTT

SEQ ID NO: 680 - protein, 1271 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGMPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQ

SEQ ID NO: 681 - protein, 1253 aa, Artificial Sequence
  source: /note="Description of Artificial Sequence: Synthetic polypeptide"
MALLLAVFRLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGSTSSGMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPE

SEQ ID NO: 682 - protein, 1302 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGGGSGGSTSSGSSGGMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPEFVIKILQFLVPLLILGLAFAVRHYTKEK

SEQ ID NO: 683 - protein, 1279 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGGGSGGSTSSGSSGGMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPEYTKEK

SEQ ID NO: 684 - protein, 1274 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGGGSGGSTSSGSSGGMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPE

SEQ ID NO: 685 - protein, 1306 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGGGSGGSTSSGSSGGMPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQYWFASITVAGLSVVVGYLCIRKKQTT

SEQ ID NO: 686 - protein, 1286 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGGGSGGSTSSGSSGGMPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQRKKQTT

SEQ ID NO: 687 - protein, 1280 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWGGGSGGSTSSGSSGGMPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQ

SEQ ID NO: 688 - protein, 1287 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPEFVIKILQFLVPLLILGLAFAVRHYTKEK

SEQ ID NO: 689 - protein, 1264 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPEYTKEK

SEQ ID NO: 690 - protein, 1259 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWMASDQKLHKFDEVSKHNKTKDCWLIINGKVYDVTPFMDDHPGGDEVLLSATGKDATNDFEDVGHSDSAREMMDKYYIGEMDMATVPLKRTYIPPQQAQYNPDKTPE

SEQ ID NO: 691 - protein, 1291 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWMPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQYWFASITVAGLSVVVGYLCIRKKQTT

SEQ ID NO: 692 - protein, 1271 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWMPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQRKKQTT

SEQ ID NO: 693 - protein, 1265 aa, Artificial Sequence
  source: /note="Description of Artificial Sequence: Synthetic polypeptide"
MDFLTIFIGPLLAIIALFYARLTISTRGKNLPPGPTPLPFIGNLHLLGHHPHKSLARLAKTYGPLMLLRLGSENTVVVSSAAVAKEVLQKHDLAFSSRSIPDAVHAHDQFKYSVVWLPVASRWRSLRKTMNSNIFSGSCLDANQHLRSRKVEELIAYCKESCRRAEAVDVGRAAFRTALNSLSNTIFSRDLADPLSDSGKEFKDVVSSIMMEAGKPNSVDYYPFLSRFDPQGIRRRTAIYFDKLINIFKGLIDERLEKRRSQYEEATDVIDILLNTIEQNPEEIDRTHIERMFLDLFLAGTDTTSSTVEWAMAEAMKNPETMKKAKAELAQVIGKGKIVQETDIPHLPYLQCIVKETLRLHPPVPFLIPRRVHEDVDILGYVVPNNSQVFVNMWAIGRDPDMWKNPLQFDPDRFHDSEVGLRGKDFELIPFGAGRRICPGLPLAMRMVPVVLGSLLNSFDWKVEGGKELEMNEKFGITLEKAQPLMAVPIALGGGSGGSTSSGSSGGWRRSSGSGKKVVEPPKLIVPKSVVEPEEIDEGKKKFTIFFGTQTGTAEGFAKALAEEAKARYEKAVIKVIDIDDYAADDEEYEEKFRKETLAFFILATYGDGEPTDNAARFYKWFVEGNDRGDWLKNLQYGVFGLGNRQYEHFNKIAKVVDEKVAEQGGKRIVPLVLGDDDQCIEDDFAAWRENVWPELDNLLRDEDDTTVSTTYTAAIPEYRVVFPDKSDSLISEANGHANGYANGNTVYDAQHPCRSNVAVRKELHTPASDRSCTHLDFDIAGTGLSYGTGDHVGVYCDNLSETVEEAERLLNLPPETYFSLHADKEDGTPLAGSSLPPPFPPCTLRTALTRYADLLNTPKKSALLALAAYASDPNEADRLKYLASPAGKDEYAQSLVANQRSLLEVMAEFPSAKPPLGVFFAAIAPRLQPRFYSISSSPRMAPSRIHVTCALVYEKTPGGRIHKGVCSTWMKNAIPLEESRDCSWAPIFVRQSNFKLPADPKVPVIMIGPGTGLAPFRGFLQERLALKEEGAELGTAVFFFGCRNRKMDYIYEDELNHFLEIGALSELLVAFSREGPTKQYVQHKMAEKASDIWRMISDGAYVYVCGDAKGMARDVHRTLHTIAQEQGSMDSTQAEGFVKNLQMTGRYLRDVWMPTLTKLYTMEEASQHNTNEDCWIVIDGKVYDVSSYVDDHPGGDDILVGATGKDATDEFEDAGHSKSARELMEKFCIGELEETTPSIPELDIVSQKQKMNDLPHKILNFTKQ

SEQ ID NO: 694 - protein, 771 aa, Artificial Sequence
  source: /note="Description of Artificial Sequence: Synthetic polypeptide"
MTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKFGGGSGMSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIP

SEQ ID NO: 695 - protein, 779 aa, Artificial Sequence
  source: /note="Description of Artificial Sequence: Synthetic polypeptide"
MTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKFGGGSGMSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYT

SEQ ID NO: 696 - protein, 776 aa, Artificial Sequence
  source: /note="Description of Artificial Sequence: Synthetic polypeptide"
MTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKFGGGGSGGGGSMSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIP

SEQ ID NO: 697 - protein, 784 aa, Artificial Sequence
  source: /note="Description of Artificial Sequence: Synthetic polypeptide"
MTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKFGGGGSGGGGSMSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYT

SEQ ID NO: 698 - protein, 781 aa, Artificial Sequence
  source: /note="Description of Artificial Sequence: Synthetic polypeptide"
MTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKFGGGGSGGGGSGGGGSMSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIP

SEQ ID NO: 699 - protein, 789 aa, Artificial Sequence
  source: /note="Description of Artificial Sequence: Synthetic polypeptide"
MTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKFGGGGSGGGGSGGGGSMSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYT

SEQ ID NO: 700 - protein, 771 aa, Artificial Sequence
  source: /note="Description of Artificial Sequence: Synthetic polypeptide"
MSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIPGGGSGMTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKF

SEQ ID NO: 701 - protein, 776 aa, Artificial Sequence
  source: /note="Description of Artificial Sequence: Synthetic polypeptide"
MSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIPGGGGSGGGGSMTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKF

SEQ ID NO: 702 - protein, 781 aa, Artificial Sequence
  source: /note="Description of Artificial Sequence: Synthetic polypeptide"
MSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIPGGGGSGGGGSGGGGSMTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKF

SEQ ID NO: 703 - protein, 779 aa, Artificial Sequence
  source: /note="Description of Artificial Sequence: Synthetic polypeptide"
MSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYTGGGSGMTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKF

SEQ ID NO: 704 - protein, 784 aa, Artificial Sequence
  source: /note="Description of Artificial Sequence: Synthetic polypeptide"
MSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYTGGGGSGGGGSMTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKF

SEQ ID NO: 705 - protein, 789 aa, Artificial Sequence
  source: /note="Description of Artificial Sequence: Synthetic polypeptide"
MSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYTGGGGSGGGGSGGGGSMTKTNSPAPSVITCKAAVVWKSGEPPKVEEIQVDPPKASEVRIKMLCASLCHTDFLACNGLPVPLFPRIPGHEGVGMIESVGENVTNLKEGDIVMPLYLGECGECLNCKSGRTNLCHKYPLGFSGLLLDGTSRMSIGEQKVYHHFSCSTWSEYIVIEAAYAVKVDPRVSLPHASFLCCGFTTGFGATWRDVNVVKGSTVAVLGLGAVGLGAVQGAKSQGASRIIGLDINDKKREKGEAFGMTEFINPKGSNKSISELINEATGGLGLDYVYECTGVPALLNEAIESSKVGLGTAVLIGAGLETSGEIKFIPLLCGRTVKGSIYGGVRPKSDLPTLIEKCINKEIPMDELMTHEVSLSEINKGFEYLKHPDCVKVVIKF

SEQ ID NO: 706 - protein, 651 aa, Artificial Sequence
  source: /note="Description of Artificial Sequence: Synthetic polypeptide"
MSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIPGGGSGMEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 707 - protein, 656 aa, Artificial Sequence
  source: /note="Description of Artificial Sequence: Synthetic polypeptide"
MSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIPGGGGSGGGGSMEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 708 - protein, 661 aa, Artificial Sequence
  source: /note="Description of Artificial Sequence: Synthetic polypeptide"
MSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIPGGGGSGGGGSGGGGSMEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 709 - protein, 659 aa, Artificial Sequence
  source: /note="Description of Artificial Sequence: Synthetic polypeptide"
MSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYTGGGSGMEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 710 - protein, 664 aa, Artificial Sequence
  source: /note="Description of Artificial Sequence: Synthetic polypeptide"
MSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYTGGGGSGGGGSMEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 711 - protein, 669 aa, Artificial Sequence
  source: /note="Description of Artificial Sequence: Synthetic polypeptide"
MSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYTGGGGSGGGGSGGGGSMEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 712 - protein, 651 aa, Artificial Sequence
  source: /note="Description of Artificial Sequence: Synthetic polypeptide"
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHAGGGSGMSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIP

SEQ ID NO: 713 - protein, 659 aa, Artificial Sequence
  source: /note="Description of Artificial Sequence: Synthetic polypeptide"
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHAGGGSGMSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYT

SEQ ID NO: 714 - protein, 656 aa, Artificial Sequence
  source: /note="Description of Artificial Sequence: Synthetic polypeptide"
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHAGGGGSGGGGSMSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIP

SEQ ID NO: 715 - protein, 664 aa, Artificial Sequence
  source: /note="Description of Artificial Sequence: Synthetic polypeptide"
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHAGGGGSGGGGSMSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYT

SEQ ID NO: 716 - protein, 661 aa, Artificial Sequence
  source: /note="Description of Artificial Sequence: Synthetic polypeptide"
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHAGGGGSGGGGSGGGGSMSWWWKRSIGAGKNLPNQNKENGVCKSYKSVALVVGVTGIVGSSLAEVLKLPDTPGGPWKVYGVARRPCPVWLAKKPVEYIQCDVSDNQETISKLSPLKDITHIFYVSWIGSEDCQTNATMFKNILNSVIPNASNLQHVCLQTGIKHYFGIFEEGSKVVPHDSPFTEDLPRLNVPNFYHDLEDILYEETGKNNLTWSVHRPALVFGFSPCSMMNIVSTLCVYATICKHENKALVYPGSKNSWNCYADAVDADLVAEHEIWAAVDPKAKNQVLNCNNGDVFKWKHIWKKLAEEFGIEMVGYVEGKEQVSLAELMKDKDQVWDEIVKKNNLVPTKLKEIAAFWFADIAFCSENLISSMNKSKELGFLGFRNSMKSFVSCIDKMRDYRFIP

SEQ ID NO: 717 - protein, 669 aa, Artificial Sequence
  source: /note="Description of Artificial Sequence: Synthetic polypeptide"
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHAGGGGSGGGGSGGGGSMSLSWWRAGAAKKRMDDDESLLVKQQQQQCVALIVGVTGLVGNSLAEMLPLPDTPGGPWKVYGVARRARPSWNEDQPMTYISCDVSNTGEVEAKLSPLSDVTHIFYATWTSRSTEEENCEANGKMLKNVLDAMIPNCPNLKHICLQTGRFHYVASVVDWKINGSHDTPLTEDLPRLKTNNFYYTQEDILLEEVKRKEGLTWSVHRPGTIFGFSPYSMMNLVGTLCVYAAICKQEGAVLRFPGCKGAWDGHSDCADADLIAEQQIWAALDPHAKNQAFNVSNGDLFKWKHLWKVLADQFGVECGDYEEGQQLRLQDVMKDKGPVWDKIVAENGLSNTKLEDVGKWWFSDTILWNECRLDSMNKSKEHGFLGFRNSKNCFLYWIHKVKAYNLVPSTYT

SEQ ID NO: 718 - protein, 270 aa, Nepeta mussinii
MANNSVMMKKKLEGKVAIVTGGASGIGEATARLFVKYGARAVVIADIQSELGRSVAESIGKERCSFVQCDVADEEQVKSMIEWTATTYGGLDVMFSNAGVLNSAAQTVKDLDLPLFDKVMRVNTRGAAVCVKQAARKMVELGRGGSIICNAGSSAVRGAHGVTDYVMSKHAVIGLVRSASMQLGAHSIRVNSVSPMAVATPLTRNQGISTPDDVQKFLMPFISLKGVPPTAEQVAEAAAFLGSDEAAFVTGHDLPVDGGVLCMPFLLGSA

SEQ ID NO: 719 - protein, 270 aa, Nepeta mussinii; identical to SEQ ID NO: 718

SEQ ID NO: 720 - protein, 258 aa, Catharanthus roseus
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 721 - protein, 264 aa, Camptotheca acuminata
MEVLSKPKKHFVLTHGACHGAWVWYKVKPRIEAAGHRFTAVNLAACGVNKKQLDEVRSLYDYTLPLLEVLASIPENEKVILVGHSGGGMSAALGMEKYPEKISVAVFLNAIMPDTTHGPSYVLDQYTGGTPPEAWKDTEFITFGDPKEPLSGLVVGPKFLKTTLYPLCSDEDYTLGTLLVRPGSLFMEDLHKADKFTDEGFGSVKRVYVVCDEDKTIPAEFQRWMIENNPVKEVKEIKGADHMPMFSKQDEVCKCLLEIAEKYN

SEQ ID NO: 722 - protein, 259 aa, Vinca minor
MAALAKHFVAVHGVGHGSWVYYKLKPRIEAAGHRFTAVNLAAAGINEKKLEEVRSSVEYAAPLLEVLGSVPENEKVILIGHSGGGMTAAVGMEKFANKISLAVFLNAIMPDTKNRPSYVLEEYTAKTPPEAWKDCQFSAYGEPPITSLVCGPEFIASTLYHLSTVEDHALGSLLVRPGSLFMEDLLQAEKFTEEGFGSVPRVYVIAAEDKTIPPEFQRWMIENNPVKEVKEIKGSDHMPMFSKPDDLCKCLLEIAKQHA

SEQ ID NO: 723 - protein, 261 aa, Rauvolfia serpentina
MEVAKLQKHFVAVHGVGHGAWVYYKLKPRIEAVGHRFTAVHLAAAGINEKKLQEVRSSVEYAAPLLEVLASVPENEKVILIGHSGGGMTAAVGMEKFPNKISMAVFLNAIMPDTKNRPSYVLEEYTARTPVEAWKDCQFSAYGDPPITSLVCGPEFISSTLYHLSPVEDHALGKLLVRPGSLFIEDLLKADKFTEKGFGSVPRVYVVAAEDKTIPPEFQRWMIENSPVKEVKEIKGADHMPMFSKPDELCQCLLEIAKQHA

SEQ ID NO: 724 - protein, 258 aa, Catharanthus roseus; identical to SEQ ID NO: 720

SEQ ID NO: 725 - protein, 264 aa, Camptotheca acuminata; identical to SEQ ID NO: 721

SEQ ID NO: 726 - protein, 259 aa, Vinca minor; identical to SEQ ID NO: 722

SEQ ID NO: 727 - protein, 261 aa, Rauvolfia serpentina; identical to SEQ ID NO: 723

SEQ ID NO: 728 - protein, 268 aa, Nepeta mussinii
MGNKKTLEGKVAIVTGGASGIGETAARVFANLGARAVVIADIQSELGREVAESIGAKRCSYVQCDIGDEEQVKSMVEWTATTYGALDVMFCNAGIMSKAESAQTVLELDMSKFDEVMRVNTRGTSACVKQAARKMVELGTKGGAIVCTSSPLASRGGYIDTDYVMSKHAVMGLVRSASMQLGAHGIRVNSVSPMAVLTPLTRRMGLATPADVENAFGRFTSLKGVALTAEHVAEAAAFLASDEAAFITGHDLMVDGGLLCLPFFAPTS

SEQ ID NO: 729 - protein, 268 aa, Nepeta mussinii; identical to SEQ ID NO: 728

SEQ ID NO: 730 - protein, 258 aa, Catharanthus roseus; identical to SEQ ID NO: 720

SEQ ID NO: 731 - protein, 264 aa, Camptotheca acuminata; identical to SEQ ID NO: 721

SEQ ID NO: 732 - protein, 259 aa, Vinca minor; identical to SEQ ID NO: 722

SEQ ID NO: 733 - protein, 261 aa, Rauvolfia serpentina; identical to SEQ ID NO: 723

SEQ ID NO: 734 - protein, 261 aa, Andrographis paniculata
MVGTAAQHFVAVHGVGHGAWVYYKVKPRMEAAGVRFTPVSLAAAGNNGKKLEEVRSLHDYTTPLLEVLAAVPAGEKVVLVGHSGGGYPAAYAMEKFPEKISVAVFVNALMPDTKNRPSYVIDEYLARTPPEAWMDTQFPTYGDPPITALVVGPKFISDSLYNLSPVEDQALGHLSVRPGSLFMEDLATMDKFSDDKFGSVRRAYIVAADDKTIPAEFQRWLIENNPVAEVKEIKGADHMPMFTQPDALCKCLLEIAQKHAA

SEQ ID NO: 735 - protein, 259 aa, Gentiana triflora
MSPTKHFVAVHGVGHGAWVYYKLKPRIEAAGFKFTAIDLAAAGVNPKKLEEVNSLEEYCGPLFDVLAAVPEGEKVILVGHSGGGLSAAVGMEKFPKKISVAVFLNAIMPDTKNRPSYVMEEYTARTPIEAWKDTQFSAYGEPPITALLCGPEFISTSLYHLSPVEDHTLGKLLVRPGALFVEDLLKGAVKFTDEGFGSVPRVYVVATEDKTIPPEFQRWMIENNPVAEVKEIQGADHLPQFSKPDELTQVLVDIAKNHG

SEQ ID NO: 736 - protein, 264 aa, Coffea canephora
MEAIKEQPKHFVAVHGVGHGAWVYYKLKPRIEAAGHRFTPVDLAGAGRNEKKLEEIRTMVDYTRPLLEVLASIPENEKVILIGHSGGGMAAAVGLEKYPNKVSVGVFLNAIMPDAKNRPSYVFEEYTARTPIEKWLDTKFFPYGDPPIMALLCGPEFISNSLYNRSPKEDQALGKLLVRPGSLFMEDLLQTEKLFTEERFGSVPQAYVIASDDKTITADFQRWMIQNNPCVKEVKEIKGADHMPMFTKPDELCQCLLEIAKTYA

SEQ ID NO: 737 - protein, 262 aa, Ophiorrhiza pumila
MEATKQQQKHFVAVHGVGHGAWVYYKLKPRIEAAGHLFRAIDLSASGANDTKLEEIHSLHEYTKPLLDVLASVPENEKVILIGHSGGGMGAAVGMEKYPDKISLAIFLNAIMPDSKNPPSYVLEQYTARTPLDAWKDTKFSAYGDPPITSLLVGPEFISSTLYHLSPKEDQALGKLLVRPGSLFIEDLLKADKFSDEGFGSVPRAYVIAGDDKTIPADFQRWMIENNPVKEVKVINGADHMPMFSKPDELCQNLLELAKKHA

SEQ ID NO: 738 - protein, 254 aa, Phelline lucida
MVHFVAVHGVCHGAWVYYKLKPRVEAAGHQFTSVNLAASGVNEKKLEELHSLHDYALPLLEVLASVPENEKVILIGHSGGGMSAAVGMENYPDKILAAVFLNAIMPDSTNRPSFVLEKYTAETPLEAWKDSQFGAFGDPPITSVIAGPEFLSVLYHLSPVEDLTLGRLLVRPGSLFIEELLKSDKFSEEKFGSVKRVYVVCTEDKCIPEEFQRWMIENNPVTEVKVIEGSDHMPMFSKPDELCQSLVEIADTYA

SEQ ID NO: 739 - protein, 261 aa, Vitex agnus-castus
MAGTEQKKHFVAVHGVGHGAWVYYKLKPRMEAAGYRFSPISLAAAGNNGKKLEEVRSLHDYTTPLLEVLASVPDGEKVILIGHSGGGYAAAYAMEKYPEKIAVAVFLNALMPDSKNRPSYVIDEYLKRTPPEAWMDTQFPTYGDPPITALVVGPKFISESLYNLSPIEDQALGHLSVRPGSLFMEDLATMDKFSDDKFGSVPRVYVIAAEDKTIPPEFQRWQIENNPVEEVKEIKGADHMPMFTQPDALAKCLGEIAEKYA

SEQ ID NO: 740 - protein, 260 aa, Valeriana officinalis
MTKDQKHFVAVHGVCHGAWVYYKVKPRVEAAGHKFTAVDLAASGANEKNLNDVTSMLEYTKPLLDVLAAIPDGEKVILVGHSGGGMAAALGMEKFPEKISVAVFVCAIMPDTTNTPSFVLEKYSAGTPPDAWKDCQFSAISDPPITCLSVGPEFLKAFLYTKCPVEDYTLATLLAKRPGSLYIEDLMKADKFTEKGFGSVPRVYVVCPEDDCIPAVFQKFMIENNPVVEVKEIPGADHMPMLSKPDELAKCFVEIAETYA

SEQ ID NO: 741 - protein, 255 aa, Stylidium adnatum
MVHFAAVHGVCHGSWVYYKVKPLVEAAGHKFTAIDLAASGVNEKKLEDLHSLQDYTSPLLDFLASLPKNEKVALIGHSGGGMSAAVGMEKYPDKILVAIFLNAIMPDTKNQPSFVLEQYSAGTPLDAWKDTKFGAYGDPPITSLSVGPEFISSTLYSLSPKEDFTLGTLLVRPGSLFIEDLMKAEKFTDEGFGSVKRVYIVCTKDKTIPEEFQRWMIKNNPVEEVKIIEGADHMPMFSKPAELCQCLVEIAKKYA

SEQ ID NO: 742 - protein, 260 aa, Verbena hastata
MAAAQPKHFVAVHGVGHGAWVYYKLKPRVEAAGYKFTPISLAAAGNNGKKIEEVRTLGDYTEPLLEALAAVPEGEKVILIGHSGGGCAAAYAMEKYPEKISVAVFLNAIMPDSKNKPSYVIDEYLARTPMEAWMDTQFVPLGDPPITGLLCGPKFISESLYNLSPLEDHALGNLSVRPGSLFMEDVATMEKFSDEKFGSVPRVYVIAAEDKTIKPEFQRWMIENNPVKEVKVIEGADHMPMFSKPDELCKCLVEIAEKHA

SEQ ID NO: 743 - protein, 262 aa, Byblis gigantea
MVGPTEKQKHFVAVHGVGHGAWVYYKLKPRIEAAGYRFTPVSLAAAGNNGKKLEEVRSLHDYTMPLLEVLAAVPEGEKVILIGHSGGGYAAAYGMEKYPEKISVAVFLNALMPDSKNRPSYVIDEYLKRTPPEAWLDTQFPTYGDPPITGLVVGPRFISESLYNLSPVEDQALGHLSVRPGSLFMEDLATLDKFSDEKFGSVPRVYVIAADDITIPADFQRWLIENNPVKEVKEIKGADHMPMFTQPDALCKCLVEIAEKYA

SEQ ID NO: 744 - protein, 261 aa, Pogostemon sp.
MVGAAQPKHFVAVHGVGHGSWVYYKLKPRVEAAGYRFSPVSLAAAGNNGKKLEEVRSLHDYTEPLLEVLAAVPDGEKVILIGHSGGGYPAAYAMEKYPDKIAVAVFLNALMPDSKNKPSYVIDEYLARTPPENWMDTQFVPFGDPPIVGLLCGPNFISQSLYNLSPIEDQALGQLSIRPGSLFMEDLATMEKFSDEKFGSVPRVYVIANEDKTIPPEFQRWQIENNPVAEVKEIKGSDHMPMFTQPDALAKCLAEIADKYA

SEQ ID NO: 745 - protein, 261 aa, Strychnos spinosa
MESAKQPKHFVAVHGVGHGAWVYYKLKPRIEAAGHRFTPVNLAASGINEQKLEEIHSLHEYTKPLLDVLASIPENEKVILIGHSGGGMSAAVGMEKYPHKISVAVFLNAIMPDSKNGASYVLEQYSARTPLDTWKDTQFSQYGDPPITALVCGPEFISTTLYHLSPVEDHALGTLLARRGSLFIEDLMKAEKFTDKGFGSVPRVYVVAAEDRTIPPEFQRWMIENNPVKEVKEIKGADHMPMFSKPDELCKCLVEIAKKHA

SEQ ID NO: 746 - protein, 256 aa, Corokia cotoneaster
MVQFVAVHGACHGAWVYYKLKPRVEAAGHKFTAVNLGASGINEKKLEELHSLYDYTLPLLEVLGSIPDGEKVVLIGHSGGGMSAALGMEKYPDKISVAVFLNAIMPDSTNRPSFVLEKYSAETPIEAWKDSKFAAYGTDPQITSVTVGPEFISSTLYHLSPVEDYTLGTLLVRPGSLFIEDLLKADKFTDGGFGSVKRVYVVCTEDRTIPEEFQRWMIKNNPVTEVKELKGADHMPMFSKPDALSQCLNEIAETYA

SEQ ID NO: 747 - protein, 258 aa, Oxera neriifolia
MAQPKQFVAVHGVGHGAWVYYKLKPRMEAAGYRFSPISLAAAGNSGKKLEEVRTLQDYTTPLLEALAAVPEDEKVVLIGHSGGGYAAACAMEKCPEKIAVAVFLNALMPDSKNRPSYVIDEYLARTPPENWMDTQFSTSGDPPIGALLCGPKFISESLYNLSPIEDQALGHLSVRPGSLFMEDLATMDKFSDEKFGSVPRVYVIAAEDKTIPPDFQRWQIENNPVAEVKEIKGADHMPMFTQPDALAKCLAEIAEKYA

SEQ ID NO: 748 - protein, 262 aa, Buddleja sp.
MAAAAVPPQHFVAVHGVGHGAWVYYKLKPRIEAAGHRFTPISLAAAGNSPKKLEEVRSLHDYTVPLLEVLAEVPEDEKVILIGHSGGGYAAAFGMEKYPEKIKVAVFLNALMPDSKNKPSYVIDEYLARTPPEAWMDTQFPSYGEPPITALVVGPKFISESLYNLSPIEDIALGHLSVRPGSLFMEDLATMDKFSDDKFGSVPRVYVIAAEDKTIPPDYQRWMIENNPVEEVKEIKGADHMPMFTQPDALCKCFVEIAEKYA

SEQ ID NO: 749 - protein, 258 aa, Gelsemium sempervirens
MQQKHFVAVHGACHGAWVYYKLKPRIEAAGHRLTPVNLGASGINEKKLEEIHSLDEYTAPLLEVLASIPENEKVILIGHSGGGMSAAVGMEKYPEKISVAIFLNAIMPDSKNRPSYVLEQYTARTPLDAWKDSQFSAYGDPPITSLVCGPEFISSTLYHLSPVEDHALGRLLVRPGSLFIEDLLKADKYFTDEGFGSVPRVYVVATEDRTIPPEFQRWMIENNPVKEVKEIKGADHMPMFSKPDELCQCLVEIAKKYA

SEQ ID NO: 750 - protein, 259 aa, Utricularia sp.
MAAVQKHFLAVHGVGHGAWVYYKLKPRMEAAGYRFSPISLAAAGNSVKKLEEVRSLHDYTTPLLEELAAVPDGEKVVLIGHSGGGIAAAYAAEQYPQKIAVAVFLNALMPDTKNRPSFVIEEYMKRTPIEAWLDTQFPTYGDPPITALVVGPKFISESLYNLSPIEDQALGHLSVRPGSLFLEDMATLPNFSDDKYGSVPRVYVIAADDKTIPADFQRWQIENYPVAEVKEIKGADHMPMFTQPDALAKALSEIADKFA

SEQ ID NO: 751 - protein, 256 aa, Scaevola sp.
MVQFVAVHGACHGAWVYYKIKPMVEAAGHKLTAVNLAACGNSDKKLSELNSLHDYTLPLLEVLEAVPAGEKVVLIGHSGGGMSAALGMEKYPEKIAAGVFICAIMPDSINRPSFVLEKYTAGTPPEAWKDSTFGAFGSEVQITSVTVGPEFLKTNLYQLCPVEDFTLATLSVRPGSIFIEDLLRAEKFTDKGLGSVKRVYVVCPEDKCIPAEFQKWMIENNPVTEVKEIKGADHMPMFSKPAELTKCLIEIAETYA

SEQ ID NO: 752 - protein, 256 aa, Menyanthes trifoliata
MVQFVACHGACHGAWVYYKLKPLVEAAGHKFTAVNLAASGVNEKKLEEVHSLHDYTLPLLEVLADVPEGEKVILIGHSGGGMSAAVAMEKYPEKISVAVFLNAIMPDSKNRPSFVLEKYGSGTPLEAWKDSKFGAYGTDPQITTVLVGPEFIKSTLYTLCSDEDITLGNLLVRPGSLFIEPLLTAEKFTDEGFGSVKRVYIVATEDKTIPEEFQRWMIENNPVTEVKEIKGADHMPMFSKPAELFKSLVEIAETYA

SEQ ID NO: 753 - protein, 260 aa, Pinguicula caudata
MAAAQPKQFVAVHGVGHGAWVYYKLKPRVEAAGYRFTPISLAAAGNNGKKLEEVRSLHDYTEPLLEALAAVPESEKVILIGHSGGGYAAAYGMEKYPEKISVAVFLNALMPDSKNRPSYVIDEYLKRTPAEAWLDTQFLPYGDPPIISLICGPKFISESLYNLSPLEDHALGHLSVRPGSLFMEDLATLPNFSDEKFGSIPRVYVIASDDKTIPPDFQRWQIENNPVAEVKEIKGADHMPMFTQPDALTKTLVEIAEKFA

SEQ ID NO: 754 - protein, 260 aa, Psychotria ipecacuanha
MAATQQKHFVAVHGVGHGAWVYYKLKPRIEAAGHRFTPVDLAAAGVNDTKLEELHSLCDYTKPLLDVLAAVPENEKVILIGHSGGGMSAAVGMEKYPNKISLAIFLNAIMPDAKNPPSHALEQYSARTPLDAWKDTKFSAYGDPPITTLLVGPEFISTTLYHLSPKEDQALGNLLARPGSLFIEDLLKADKFTEKGFGSVPRTYVIAADDKTIPADFQRWMIENNPVKEVKEIKGADHMPMFSKPDELCLTLMELAKKYA

SEQ ID NO: 755 - protein, 259 aa, Dipsacus sativum
MPTQQKHFVAVHGVCHGSWVYYKLKPRVEAAGHQFTAVNLAASGVNEKKLEEVTSLDEYTKPLYEVLAAVPENEKVILVGHSGGGMAAALGMEKYPEKISVAVFVCAIMPDSTNSPSFVLEKYSGGTPIDAWKDSQFGVFGDPPITSITVGPNFLKSTLYTLCPVEDFTLATLMVRPGSLYIEDLMKADKFTDKGFGSVPRVYVVCPEDKTIPVEFQKWMIENNPVTEVKEIVGADHMPMMSKPDELCKCLGEIADKYA

SEQ ID NO: 756 - protein, 258 aa, Exacum affine
MAPKHFVAVHGVGHGAWVYYKLKPRIEAAGHQFTAIDLAAAGVSEKKLEEVHSLNDYVAPLLDALASVPEGEKVILVGHSGGGLSAAVGMEKYPEKISVAVFLNAIMPDTKNRPSYVMEEYNARTPLDAWKDTKFLSYGDPPLTALLCGPEFISSSLYHLSPVEDHALGKLLVRPGALFVEDLVRGDVTFTEEKFGSVPRVYIVAKEDRTIPADFQRWMIENNPVKEVKEIEGSDHLPQFTKPDELCQYLVDIANKYG

SEQ ID NO: 757 - protein, 257 aa, Chionanthus retusus
MPKAHFVAVHGVGHGAWVYYKLKPRIEAAGHRFTALNLAAAGVNEKKLEEVRSLSEYTTPLLDFLASVPENEKVILIGHSGGGMSAAVGMEKYPEKILVAVFLNAIMPDSKNSPSYVLEQYSGKTPLDAWLDTQFSAYGDPPITALTVGPKFISNSLYHLSPVEDHALGELLVRRGSLFIEDLLQADKFTDENFGSVPRVYFVATEDRTIPAEFQRWMIENNPVEEVKEIKGADHMPMFSQPDELCKCLVEVAEKYA

SEQ ID NO: 758 - protein, 255 aa, Allamanda cathartica
MKHFVAVHGAGHGAWVYYKLKPRIEAAGYRFTPVNLAASGINEKKLVEVRSLDEYTKPLLDVLASVPEDEKVILIGHSGGGMSAAVGMEKFPKKISIAVFLNAIMPDAKNRPSYVLEEYTARTPPDAWKDSQFSVYGDPPITSLICGPEFISSTLYHLSPIEDHALGNLLVRPGSLFIEDLLKAEKFTEEGFGSVPRVYVIAAEDKTIPPEFQRWMIENNPVKEVKEIKGADHMPMFSKPDELCKCLLEIAKKYA

SEQ ID NO: 759 - protein, 260 aa, Phyla dulcis
MAAAQPKHFVAVHGVGHGAWVYYKLKPRVEAAGHRFTPISLAAAGNDGKKIEEVRTLHGYTTPLLEALAAVPEGEKVILVGHSGGGYPAAYAMEKYPEKISVAVFLNALMPDSKNKPSYVIDEYLARTPMEAWMDTQFLPLGDPPITGLLCGPKFISESLYNLSPIEDQVLGHLSVRPGSLFMEDLATMEKFSDEKFGSVPRVYVIAAGDVTIKPEFQRWQIENNPVKEVKVIEGADHMPMFTKPDELCKCLVEIAEKHG

SEQ ID NO: 760 - protein, 257 aa, Ligustrum sinense
MPKAHFVAVHGVGHGAWVYYKLKPRIEAAGHKFTALNLAAAGINDRKLEEVRSLSEYTTPLLDFLAAVPENEKVILIGHSGGGMSAAVGMEKYPEKIAVAVFLNAIMPDSKNSPSYVLVQYSGKTPPDAWLDTQFSAYGDPPITALTVGPKFISNSLYHLSPVEDHALGELLVRPGSLFIEDLLQADKFTDEKFGSVPRVYIVATEDRTIPAEFQRWMIENNPVKEVKEVKGADHMPMFSQPDALCKCLVEVAEKYA

SEQ ID NO: 761 - protein, 261 aa, Pyrenacantha malvifolia
MESSKQPKHFVAVHGVCHGAWVYYKIKHLIEAAGHRFTPVSMAASGNSQKKLEEVSSLHDYTLPLLEVLGSLPENEKVILVGHSGGGMSAALGMEKFPEKISVAVFLNAIMPDTSHGPSFVLEQYTARTPLNAWKDSQFSAYGDPPITSFVVGPEFISSTLYHLSPIEDITLGKLSVRPGSLFMEDVMKADRFTEEGFGSVKRVYVVATEDKTIPPAFQRWMIMNNPVEEVKEITGADHMPMFSKPNQLCKCLLDIAEKYA

SEQ ID NO: 762 - protein, 259 aa, Sambucus canadensis
MGKDQKHFVAVHGVCHGAWVYYKVKPRVEAAGHRFTAVNLAAAGVDQTKPEDVKSLCDYTKPLLDVLESIPEGEKVILIGHSGGGMSAAVAMDKYPHKISVAVFLNAIMPDTAHPPSFVLEKYSGGTPLDAWKDTQFSQYGEPPVTALLVGPEFISSTLYHLSPVEDHTLGTLLVRPGSLFIEDLVKLENFTEKGFGSVTRVYVVATEDKTIPPEFQRWMIENNPVAEVKEVEGADHMPMFSKPDQLCKCLVEIAEKYA

SEQ ID NO: 763 - protein, 261 aa, Leonurus japonicus
MEVLSKPKHFVAVHGVGHGSWVYYKLKPRIEAAGYRFSPISLAAAGNNGKKLEEVRSLHDYTEPLLEALAAVPEGEKVVLVGHSGGGYPTAFAMEKYPEKIAVAVFVNALMPDSKNRPSYVIEEYLGRTPQENWMDTQFLSYGDPPISALLCGPKFITDSLYNLSPAEDHALGQLSVRPGSLFMEDLMTMEKFSDEKFGSVPRVYVIAAEDKTIPPEFQRWQIENNPVAEVKEIKGADHMPMFTQPDALAKCLAEIAEKYA

SEQ ID NO: 764 - protein, 259 aa, Ajuga reptans
MAGTPKQFVAVHGVGHGAWVYYKLKPRMEAAGFRFSPISLAAAGNNGKKIEEVRTLHDYTTPLLEALAAVPEDEKVILIGHSGGGYAAAYAMEKYPEKISVAVFLNALMPDSKNRPSYVIDEYLARTPPENWMDTQFPTFGDPPIGGLICGPKFISESLYNISPIEDQALGHLSVRPGSLFMEDLATMEKFSDEKFGSVPRVYVIAAEDKTIPPDFQKWQIENNPVAEVKEIKGADHMPMFTQPDALAKCLAEIAEKHA

SEQ ID NO: 765 - protein, 261 aa, Paulownia fargesii
MVGGSQPKHFVAVHGVGHGAWVYYKLKPRIEAAGYRFTPVSLAAAGNNGKKLEEVRSLHDYTTPLLEVLASVPEGEKVILIGHSGGGYPAAYGMEKYPEKISVAVFLNALMPDSKNRPSYVIDEYLARTAPEAWLDTQFPTYGDPPITALVVGPKFISESLYNLSPIEDQVLGHLSVRPGSLFMEDLATLDKFSDEKFGSVPRVYVIAAEDKTIPPDFQRWLIENNPVKEVKEIKGADHMPMFTQPDALCKCLVEIAEKHA

SEQ ID NO: 766 - protein, 263 aa, Caiophora chuquitensis
MALEKQQKHFVLTHGACHGAWVWYKVKSKIEAAGHRFTAVNLGASGVNTKKLEEVWSLKDYTEPLLEVLGSIPEDETVILVGHSGGGMSVALAMEKYPNKISVAVFLNAIMPDSTNPPSFVLDKYSGGTPPEAWKDTQFLSFGDPKKPQTGLIVGPQFLKSTLYHLCSDEDFTLGTLLVRPGSLFLEDLPTLEKFSDEGFGSVKRVYIVCDEDKTIPVEFQRWMIENSPVSVVMEINGADHMPMFSKPNEVCQSLLEIADKHA

SEQ ID NO: 767 - protein, 261 aa, Plantago maritima
MVGEVQPKQFLAIHGVGHGSWVYYKVKPRMEALGYKFTPISLAAAGNSPKKLEEVRSLHDYTTPLLEALAAVPEGEKAVLIGHSGGGYAAAYAMEKYPEKIAVAVFLNALMPDTKNRPSFVIDEYLKRTPIEEWMDTQFPTYGEPPITALICGPKFISKSLYNLSPIEDQALGHLSIRPGSLFMEDLAVLPNFTEEKFGSVPRVYFIAADDKTIKPDFQRWLIENNPVKEVKEIKGADHMPMFTQPDELTKCLAEIAEKYA

SEQ ID NO: 768 - protein, 261 aa, Antirrhinum braun
MVGEVQPKHFVAVHGVGHGAWVYYKLKPRIEAAGHKFTPISLAAAGNSNKKIEEVRTLHDYTEPLREALAAVPEGEKVILIGHSGGGYAAAFGMEKHPEKISVAVFLNALMPDSKNRPSYVIEEYLKRTPPEAWMDTQFPTFGDPPIGGLLCGPKFISESLYNLSPIEDHALGHLSIRPGSLFMEDLATMDNFSDDKFGSVPRIYVIAADDKTIPPEFQKWQIENNPVVEVKEIKGADHMPMFTKPDELCKCLVEIAEKYA

SEQ ID NO: 769 - protein, 261 aa, Cyrilla racemiflora
MGGVMQQKHFVATHGVGHGSWVYYKLKPRIEAAGHRLTPVDLAASGVNEKKLEEVLTLDEYTTPLLEVLASIPENEKVVLIGHSGGGMAAAVGMEKYPEKIAVAVFLNAIMPDSKNRPSYVLEQYSAKTPLDAWLDTQFSTYGCPSITSLLVGPKFISSSLYHLSPVEDQALGTLLMRPGSLFIEDLLKADNFTDEKFGSVPRVFVVATEDKVIPPEFQRWMIENNPVKEVKEIKGSDHMPMFSKPDELCQCLVEIAETYA

SEQ ID NO: 770 - protein, 264 aa, Hydrangea quercifolia
MEVVKQSKHFVLVHGSCHGAWCWYKIKPRLKSAGHRVTTLDLAASGINTKEVQEIYTLREYSKPLLEIMESIEEDDQKVILVGHSYGGMSLALAMDMYPHKISVAVFMAAFMPDTVHRPSHVLDKYTGGTPLEAWKDTQFLAFGDPEKPQTGLIFGPEFLKTTLYHLCSVEDFTLGTLLVRPGSLFMEDLHTLGKLTNEGFGSVTRVYIVCDEDKTIPAEFQRWMIENNPVTEVKEINGADHMPMFSKPNEVFQCLLEIATKYA

SEQ ID NO: 771 - protein, 262 aa, Cinchona pubescens
MAATNQQPKHFVAVHGVSHGAWVYYKLKPRIEATGHRFTPVDLAASGKNETKLEELHSITDYTKPLLEVLASVPENEKVVLVGHSGGGMAAAVGMEKYPHKISLAIFLNAIMPDTKNRPSYVLEQYSAKTPLDAWKDTQFFVYDDPPITAMTVGPEFISSTLYHLSPKEDHALGKLLVRPGTLFMEDLVKLDNFTDKGFGSIPRVYVIAGDDKTIPPDFQRWMIENNPVKEVKEIKGADHMPMFTKPDVLCQCLLELANKHA

SEQ ID NO: 772 - protein, 263 aa, Actinidia chinensis
MEVTKKKLHFVGTHGMCQGAWIWYKVKPRVEAAGHRFTAVDLGACGRNPKTLDEVRTLYDYTLPLLEALASIPENEKVVLVGFSGGGFSAAVAMEKYPKKIALAIFLNATMPDTTHEASYVLDQYALGISGDTWKDTQFSTYGDPNEPLTSLLVGPKFMKSTTFQHCSIEDLTLATMLVRPGSLFMEDLKKAKKFTDEGFGSVKRVCVLCEQDLCLSAEFQRWMIENNPVEEVAAIEGADHMIMFSNPEKLCEVLLEMAQKHT

SEQ ID NO: 773 - protein, 259 aa, Swertia japonica
MSSNKHFVAVHGVGHGAWVYYKLKPRIEAAGYRFTAIDLAAAGVSSKKLEDIHSLNEYCEPLFDVLSSVPENEKVILVGHSGGGLSAALGMEKYSEKISVAVFLNAIMPDTKNRPSYVMEEYTARTPIEAWKDTKFSAYGEPPITALLCGPEFISTSLYHLSPVEDHTLGKLLVRPGALFVEDLIKGEVKFTEEGFGSVPRVYVVATEDKTIPAEFQRWMIENNPVKEVKEIEGADHLPQFSKPDELSKVLVDIAKNYG

SEQ ID NO: 774 - protein, 261 aa, Sesamum indicum
MAAAAKSKHFVAVHGVGHGAWVYYKLKPRVEAAGYQFTPVSLAAAGNNGKKLEEVRSLHDYTTPLLEVLAAVPEGEKVILIGHSGGGYAAAYGMEKYPEKISVAVFLNALMPDSKNKPSYVIDEYLARTPPEAWMDTQFPTYGDPPITALVVGPKFISESLYNLSPLEDQALGHLSVRPGSLFMEDLATMDKFSDEKFGSVPRVYVIAAEDKTIPPSFQKWQIENNPVVEVKEIKGADHMPMFTQPDALCKCLVEIAEKHG

SEQ ID NO: 775 - protein, 322 aa, Isodon rubescens
MASREGEVVCVTGGSGFIGSWIVHLLLRRGYTVRATVKNLGDERETKHLEAIEGADSRLRLFQIDLLDYDSVAAAVSGAAGVFHLASPCVIDQVHDPQRELLDPAIKGTINVLTAAKALGVRRVVITSSISAMIPSSNNLADVGEDSWIDEDYCRQNGLWYPLSKALAEKAAWKFAEENGLDIVVVNPGMVVGPINPPALNSSMQLMLRVLQGNDFFEGFFMALVHVKDVALAHLLLYENTSAAGRHLCVESLSRYDDFAEKMGKLYPEYKLPRPSSKDTQHGSLKSDAALKKLKDLGLEFIPLEQMIKDSIESLRSKGYIS

SEQ ID NO: 776 - protein, 322 aa, Prunella vulgaris
MANKEGEVVCVTGASGFIGSCLVHHLINRGYTVRATVKNLADERETKHLEAIEGAHSRLHLFQIDLLDYDSIAAAVSGAAGVFHLASPCVIHRVDDPQRELLDPAIKGTVNVLKAAKNLNIRRVVVTSSISAMIASSSSLADVGEDCWIDEDFCRQNGFWYPLSKALAEKAAWRFAEENGLDIVVINPGMVVGPILPPALNSSMQLMLDVLQGKDFSEGFFMTLVHVKDVALAQILLYENTSATGRHLCVESLSRYDDFAEQMEKLYPEYKLPRFSNDHTQDESLKSNAALKKLIDLGMEFTPLKQIVKESIESLRSKGYLS

SEQ ID NO: 777 - protein, 321 aa, Agastache rugosa
MANKEGEVVCVTGGSGFIGSWLVTLLLRRGYSVRATVKNLGDERETKHLGAIEGADSRLRLFQIDLLDYDSIVAAVAGAAGVFHLASPCVIDQVRDPQRELLDPAIKGTLNVLTAAKNLDVRRVVVTSSISAMIASSNSLAETGEDCWIDEDYCRQNGLWYPLSKALAERAAWKFAEENGLDIVVVNPGMVVGPILPPALNSSMQMILRALQGKDFPEGFFMALIHVKDVALAEILLYENTSAAGRHLCAESLSRYDDFAEQMEKLYPEYKLPRFANDTQRGSLKSNAALKKLIDLGLEFTPLEQIVKDSIESLRSKGYIS

SEQ ID NO: 778 - protein, 322 aa, Melissa officinalis
MVISEEGEVVCVTGASGFIGSWLVHLLLRRGYTVRATVKNIGDERETKHLEALEGADSRLRLFQIDLLDYDSIVAAVSGAAGVFHLASPCIIDQVEDPQRELLDPAIKGTINVLTAAKNLNVRRVVVTSSISAMIASSSSLADTSEDCWIDEDYCRQNGLWYPLSKALAEKAAWQFAKESGLDIVVVHPGMVVGPIIPPALNSSMRLMLHVLQGKDFSEGFFMALVHVKDVALAEIMLYENTSAAGRHLCVESLSRYDDFAEQVAKLYPEYKLPRFLTDTQRESPKSNAASMKLVDLGMVFTPLEQIVKDSIESLRSKGYLS

SEQ ID NO: 779 - protein, 321 aa, Micromeria fruticosa
MVNKEGEVVCVTGGSGFIGSWVVNLLLRRGYTVHATVKNLGDESETKHLEALEGADSRLRLFQIDLLDYDSIVAAISGAAGVLHLASPCTIVQVEDPQRELLDPAVKGTINVLTAAKNLDVRRVVVTSSISAMIASSNNLADAGEDCWIDEDYCRQNGLWYPLSKVLAEKAAWKFAEENGLDIVVVNPGMVVGPIFPPALNSSMQLILNVLQGKDFPEGFFMALVHVKDVALALILLYENTSAAGRHLCVESLSRYDDFAKQMEKLYPEYKLPRLSNDTLLGSPKSNAASKKLIDLGLEFTPLEQTVKDSIESLRSRGYLS

SEQ ID NO: 780 - protein, 324 aa, Plectranthus caninus
MARREGEVICVTGGSGFIGSWIVHLLLHRGYTVRATVKNLGDERETKHLEAIEGADSRLRLFQIDLLDYDSIAAAVSGAAGVFHLASPCVIDQVQDPQRELLDPAIKGTINVLTAAKELGVRRVVITSSISAMIASSNNLADVAEDCWIDEDYCRQNGLWYPLSKVLAEKAAWKFAEENGLDIVAVHPGMVVGPIIPPALNSSMKLMLRVLQGDNDFSEGFFLALVHVKDVALAHLLLYENTSATGRHLCVESLSCYADFVKTMEKLYPEYKLPRPSIDTQHGSLKSDAAAALKKLIDLGMEFIPLEQIVKDSIESLRSKGYIS

SEQ ID NO: 781 - protein, 320 aa, Rosmarinus officinalis
MANKEGEVVCVTGASGFIGSWIVHLLLRRGYAVRATVKNIGDERETKHLEAIEGAASRLRLFQIDLLDYDSIAAAISGAAGVFHVASPCTIDKVEDPQRELLDPAIKGTLNVLTAAKNLDVRRVVITSSISAMIASSNSLADVDEDCWIDEDYCRQNGLWYPLSKALAEKAAWKFAEENGLDIVVVNPGMVVGPILPPALNSSMQLMVRVLQGCDFFEGFFMALVHVNDVALAHILLYENTSAAGRHLCVESLSSYDDFAELMEKLYPEYKLPRFCKDKHGSVKSDAAMKKLIDMGMEYTPMEQIVNDAIQSLRSKGYLS

SEQ ID NO: 782 - protein, 321 aa, Nepeta mussinii
MADKEGEVVCVTGGSGFIGSWLVTLLLRRGYSVRATVKNLGDERETKHLEAIEGADSRLSLFQIDLLDYDSVATAVGDAAGVFHLASPCTIDQVNDPQRELLDPAIKGTLNVLKAAKNLGVRRVVVTSSISAMIASSNSLAETGEDCWIDEDYCRQNGLWYPVSKALAEKAAWKFAEENGLDIVVVNPGMVVGPILPPALNSSMQLMLHVLQGKDFFEGFFMGLVHVKDVALAEILLYENTSASGRYLCVESLSRYDDFAKQMEKLYPEYKLPRFSNDTQHGSLKSDAALKKLRDLGIEFAPLEQIVKDSIESLRSKGYIS

SEQ ID NO: 783 - protein, 277 aa, Catharanthus roseus
MDFLATSEGQFFVAVAVSLVAVGVAYFVLSSKKPKVCLNPENFKEFKLVKKTQLSHNVASFKFALPTPTSVLGLPIGQHISCRGKDSQGEEVIKPYTPTTLDSDVGYFELVIKMYPQGRMSHHFREMQEGDYMAVKGPKGRFKYQPGQVRAFGMLAGGSGITPMFQVARAILENPNDTTKVHLIYANVTADDILLKDELEGLTKNYPDRFKVYYVLNQPPEVWNGGVGFVSKEMIQAHCPAPSSDIKILRCGPPPMNKAMAAHLEAIGYAPEMQFQF

SEQ ID NO: 784 - protein, 277 aa, Nepeta cataria
MDFLATSEGQLVVGVAVGLLAIGAAYFLFSPKKPKVCLDPENFKEFKLVKKTQLSHNVAKFRFDLPTPTSVLGLPIGQHISCRGKDSQGEEVIKPYTPTTLDSDVGYFELVIKMYPQGRMSHHFREMKEGDYMAVKGPKGRFKYQPGQVRAFGMIAGGSGITPMFQVARAILENPNDRTKVQLIYANVTYDDILLKDEIDSLAKNYPDQFQVYYVLNQPPEVWNGGVGFVSKEMIQAHCPAPASDVKILRCGPPPMNKAMAANLEALEYSPEMQFQF

SEQ ID NO: 785 - protein, 281 aa, Arabidopsis thaliana
MDTEFLRTLDRQILLGVFVAFVAVGAGAAYFLTSSKKRRVCLDPENFKEFKLVKRHQLSHNVAKFVFELPTSTSVLGLPIGQHISCRGKDGQGEDVIKPYTPTTLDSDVGRFELVIKMYPQGRMSHHFREMRVGDHLAVKGPKGRFKYQPGQFRAFGMLAGGSGITPMFQVARAILENPTDKTKVHLIYANVTYDDILLKEELEGLTTNYPEQFKIFYVLNQPPEVWDGGVGFVSKEMIQTHCPAPASDIQILRCGPPPMNKAMAANLEALGYSPEMQFQF

SEQ ID NO: 786 - protein, 277 aa, Catharanthus roseus; identical to SEQ ID NO: 783

SEQ ID NO: 787 - protein, 277 aa, Nepeta cataria; identical to SEQ ID NO: 784

SEQ ID NO: 788 - protein, 281 aa, Arabidopsis thaliana; identical to SEQ ID NO: 785

SEQ ID NO: 789 - DNA, 1056 bp, Saccharomyces cerevisiae
atggcttcagaaaaagaaattaggagagagagattcttgaacgttttccctaaattagtagaggaattgaacgcatcgcttttggcttacggtatgcctaaggaagcatgtgactggtatgcccactcattgaactacaacactccaggcggtaagttaaatagaggtttgtccgttgtggacacgtatgctattctctccaacaagaccgttgaacaattggggcaagaagaatacgaaaaggttgctattctaggttggtgcattgagttgttgcaggcttactggttggtcgccgatgatatgatggacaagtccattaccagaagaggccaaccatgttggtacaaggttcctgaagttggggaaattgccatctgggacgcattcatgttagaggctgctatctacaagcttttgaaatctcacttcagaaacgaaaaatactacatagatatcaccgaattgttccatgaagtcaccttccaaaccgaattgggccaattgatggacttaatcactgcacctgaagacaaagtcgacttgagtaagttctccctaaagaagcactccttcatagttactttcaagactgcttactattctttctacttgcctgtcgcattggctatgtacgttgccggtatcacagatgaaaaggatttgaaacaagccagagatgtcttgattccattgggtgaatatttccaaattcaagatgactacttagactgcttcggtaccccagaacagatcggtaagatcggtacagatatccaagataacaaatgttcttgggtaatcaacaaggcattagaacttgcttccgcagaacaaagaaagactttagacgaaaattacggtaagaaggactcagtcgcagaagccaaatgcaaaaagattttcaatgacttgaaaatcgaccagttataccacgaatatgaagagtctgttgccaaggatttgaaggccaagatctcccaagtcgacgagtctcgtggcttcaaagccgacgtcttaactgcgtttttgaacaaggtttacaagagaagtaaa

SEQ ID NO: 790 - DNA, 1056 bp, Saccharomyces cerevisiae
atggctagtgagaaagagattcggagggagcgattcttgaacgttttccccaaattagttgaggaattaaacgcttcccttttggcgtacggtatgccaaaagaggcgtgcgattggtacgctcattcactaaattacaacacccccggaggcaaattaaaccgtggtctgagtgtcgtggatacatatgctatcttatctaacaaaaccgtcgagcagctgggccaagaggaatacgaaaaggttgcaatactgggatggtgcatcgaactattacaagcttattggttagttgctgacgacatgatggacaagtctataacccggagagggcaaccatgttggtacaaagttccagaggtcggtgaaatcgccatttgggacgcctttatgttggaagctgctatatataagttgttgaaatctcattttaggaacgagaaatactatattgatatcactgaattatttcatgaggttacatttcaaacggaacttggacaattgatggacctgattaccgctcctgaagacaaagttgatctttcaaagttcagtctcaaaaaacattcattcatagttacattcgaaaccgcttattattctttttacttgcctgtagccctagctatgtacgtagctggcatcacggatgagaaagacttgaagcaagccagggatgttttgatacctctaggggaatactttcaaattcaggatgattatttagattgcttcggcacaccggaacagatcgggaagattggtacagacattcaagataataagtgtagttgggtaattaacaaggctttggaattggccagcgctgaacagaggaagacacttgatgaaaactacggtaaaaaagattctgtagctgaagccaagtgtaagaaaatatttaacgatttgaaaattgaacaactatatcacgaatatgaagagtctattgcgaaagatttaaaagccaaaatttctcaggttgacgaatctagaggttttaaagccgatgtgctaactgccttccttaataaagtctacaaaagatctaaa

SEQ ID NO: 791 - DNA, 888 bp, Abies grandis
atgttcgattttaataagtacatggactcaaaggcgatgaccgttaacgaagcgttaaacaaggctattcccttacgatatccacagaagatctatgaatcgatgaggtattcattattagctggaggtaaaagagtcaggccagtcttatgtattgctgcttgtgaacttgtaggtggtaccgaggaattagcaattccgactgcatgtgctatagagatgatacatacgatgagcttgatgcatgatgatcttccatgcattgataatgatgatctgcggcgtggcaaacctacaaatcataagatatttggtgaggataccgcagtcacagcaggaaatgctttgcacagttacgccttcgaacatatagccgtatcaacgagtaaaactgttggggctgatagaatactgagaatggtttcagaattaggccgcgccaccgggtctgaaggagttatgggaggacaaatggtagatattgcgtccgaaggggatccaagtatcgatttgcagacattggaatggatccatatacacaagacagccatgttgttagagtgctccgtcgtttgtggtgccataattggtggtgcttcagaaatcgtcattgaaagagcaaggcgttatgccagatgtgttggactattgtttcaggtagtggacgatattttagatgtcactaaaagtagtgatgaattgggcaagacagctggtaaggacctgatcagcgataaagcaacctacccaaaactcatgggcctggaaaaggccaaggaattttcggatgagctgctaaatagagctaagggcgaactatcctgcttcgacccagttaaagctgcacctttgttgggtttagctgactacgttgctttcagacagaac

SEQ ID NO: 792 - DNA, 1080 bp, Catharanthus roseus
atggcaaacgtaggacaacaagtgcaaagacaatctaactcagtcgctgaggaaccgttagatccattctctctggttgcagatgagctatcgattttggctaatcgactaagatctatggttgtcgctgaagtgccaaaactagcgtctgcagcagagtacttcttcaagcttggtgtagaagggaaacgttttcgtcctactgtattgttgctaatggcaacagcaattgatgcccccatttcaaggactcctccagacacttccttagacacattaagtacagaattacgtttgagacaacagaccatcgctgaaattacaaaaatgattcatgtcgcttcacttctacatgatgatgtattggacgacgctgagactcggaggggcataggctccttgaatttcgtcatgggtaacaagttggctgttttggcaggcgattttttattgtctagagcttgtgtggctttagctagcctaaaaaatactgaagtagtaagcttattagcaacagtcgtggagcatctagtcactggtgagacaatgcaaatgaccaccacttcagatcaaagatgctcgatggaatattatatgcaaaaaacatattatatgactgcttcattgatttcgaattcttgcaaggctattgcgttactggccggtcaaacttctgaggtcgctatgcttgcatacgaatacggcaaaaacctcggcttggcttttcaattaattgatgatgtcttagattttacaggtacatctgcttcgcttggtaagggttctttgtcggatattaggcacgggattgttactgcaccgattctatttgcaattgaagaattccccgaactcagagccgtcgttgacgaaggcttcgagaatccttataacgtggatttggctttacactatttgggaaaatctcgcgggatccaaagaacaagagagttggctattaaacatgccaatttggcatctgatgcaattgattctttgccagttacagatgacgaacatgtgttgagatctagaagagcattggtggagttgactcaacgtgttataacaagacggaaa

SEQ ID NO: 793 - DNA, 891 bp, Picea abies
atggaatttgatttcgataagtatatgcattctaaggcaattgccgtgaatgaagcattagataaagtaataccaccccgttatccacaaaaaatctacgaatccatgagatatagccttttggctggcggtaaaagggttagacctatactttgtatagccgcctgtgagttgatgggtggtactgaggagttagctatgccaaccgcttgtgcaattgagatgatccacacgatgagcctcatacatgatgatctaccttatattgacaatgatgacttaagacgtggcaagccaacgaaccacaaggttttcggagaggatacagctattattgcgggcgacgctttgctatctctagcatttgaacatgtagcagtatctacttcccgcactttagggactgacatcattttacgcttattgtcagagataggtcgtgccactggttctgagggagtcatgggtggtcaggtcgtcgatatcgaatccgaaggagatccttcgattgatctagaaacactagaatgggtgcacattcataaaactgcagtattgttagagtgtagtgttgtttgtggagcaattatgggaggtgcttctgaggacgacatcgaacgagcaagacgctacgcaagatgcgtaggtttactattccaagtagttgacgatatattggatgtttcccaatcttccgaagaattagggaagactgcaggtaaagacttaatatcggacaaggcgacataccccaaactcatgggtttggaaaaggccaaggaattcgctgacgagttgctaaatagaggcaagcaagaactgagctgcttcgacccaactaaagctgcccctttattcgccctagcagattacattgcatctaggcaaaat

SEQ ID NO: 794 - DNA, 891 bp, Geobacillus sp.
atggcccagctgtcggttgagcaatttctgaacgagcagaagcgcgcggtggaagccgccctgtcgtcctacatggcacgactacgtggacccgagacccttaagaaagctatggcttactcactggaagctggcggtaaacgaattcggccacttctccttctggcaactattcaggctctcgggaaggaccctgctataggcctgcctgtggcctgtgcaatcgagatgatccatacctatagcctaatccatgacgatcttccttcaatggataacgatgatctgcgacgtggtaaacccacaaaccacaaggtttttggcgaggccatggcaattctagccggcgatgccctgcttacttacgccttccaactgattgctgaggtcgacgatgatcgcgtgccgccctctgtccgtctccagctgatcgaacagcttgctaaggcggctggtccggaggggatggtcgccggccaagcggcagatatggaggcggaaggcaaaaccctcgccttggctgagttggagtacattcaccgacacaagaccggcaagatgctgcaatactctgtgcatgctggtgccctccttggaggcgcagatgggagacagaccagggagctgaatgagttcgcagctcaccttggacttgctttccagattcgggatgacatcctcgacattgaaggtatggaagaaaagatcggcaagcgagtcggttcggacagagacaacaagaaggccacttaccccgttctgctatcactgggtggtgcaaaagagaagctcgccttccacatcgacgctgctaagagacaccttcagcaggctaaaattgatgacgccgtcctcgcttacatttgtgaattggtcgccgtgcgggaccac

SEQ ID NO: 795 - DNA, 1056 bp, Saccharomyces cerevisiae
atggcttctgaaaaggagattcgtagagaacgatttctcaacgtttttcctaagcttgtcgaggagctaaatgcctctctcttggcctacggtatgcccaaagaggcctgcgactggtacgctcattcgctaaactacaacacacccggggggaagctaaaccgcggtctgtcggtcgttgatacctacgccatcttgtccaataagactgtcgaacagttgggacaggaggagtacgaaaaggtagctatcttgggctggtgcattgagctgttgcaggcctactttctcgtggctgacgatatgatggacaagtctattacccgaagaggacagccctgctggtacaaggtgcccgaggtcggcgagattgccattaacgatgctttcatgcttgaggctgccatttataagctgctgaagtcacactttcgaaacgaaaagtactacattgacatcaccgagctcttccatgaggtgacgttccaaaccgagctgggacaactgatggacctcataaccgcgcccgaggacaaggtggacctgtcaaaattttccctcaaaaagcacagcttcatcgttactttcggaaccgcatactattcattttatctgccggtagccctggcgatgtacgtagcgggcatcaccgacgagaaagacctgaagcaggctcgggacgtgctcatccccctcggcgagtactttcagattcaggacgattacctggactgctttggaactccagagcaaattggcaagatcggaaccgacatccaagacaacaagtgctcctgggtgatcaacaaggctctagaactggctagtgcagagcagcggaagactttggatgagaactacggcaagaaagacagcgttgctgaggccaagtgtaaaaagatctttaacgacttgaagatcgagcagctataccatgagtacgaggagtcgattgctaaagacctgaaagccaaaatcagccaggtcgatgagagccgaggtttcaaggcagacgtcctgactgcttttctgaacaaggtctacaagcgaagtaaa

SEQ ID NO: 796 - DNA, 1056 bp, Saccharomyces cerevisiae
atggccagtgagaaggagattcgacgtgaaagattcctgaacgttttcccgaaactggtcgaggaactcaacgcctccttgctcgcttatgggatgcccaaggaagcctgtgactggtacgcccactctctcaactacaatacgcccggaggtaaactgaaccgtggcttgtctgtggttgatacatacgccatcctgtctaacaagacagtcgagcagctaggccaggaggagtacgaaaaggtcgccattttgggctggtgtatcgagctcctgcaagcttacttcctggtcgccgatgatatgatggacaagtccattacccggcgaggacaaccatgttggtacaaggtgcctgaggttggcgaaattgccatcaacgatgcattcatgttggaggccgccatttacaagctgctgaaatcgcacttcagaaacgagaagtactacattgacattactgaactattccatgaggtcacatttcagaccgagcttggccagttgatggatcttattactgctccggaggacaaggtggacctgtcgaagttcagtctcaagaaacattctttcatcgtgactttcaagaccgcttattattccttttatctccctgttgcccttgcaatgtacgtcgcaggaatcacagacgaaaaggaccttaagcaggcacgagacgtgcttattccactcggcgaatactttcagatccaggacgattacctcgactgctttggcacccccgagcaaatcggcaagattggcactgatattcaggataacaagtgctcttgggtgattaacaaggccttggaattggcgtcggccgagcaacgtaagactctggatgagaactacgggaagaaggacagtgtggctgaggcaaagtgtaaaaagatcttcaacgacctgaagatcgaacagctataccacgagtacgaggagtcgattgccaaggatctgaaggcaaaaatctcacaggttgacgagtcgcgaggcttcaaagccgacgtcctcaccgccttcctcaacaaggtgtacaagcgatcgaag

SEQ ID NO: 797 - DNA, 1056 bp, Saccharomyces cerevisiae
atggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 798 - DNA, 1041 bp, Neosartorya fumigata
atggctactacaacctcgcgagcagccttcgaggctgtctttccgactcttgccgaggacttgctggcccacgctaagaaatacaacctgcctgagaatgctgtcaagtggttcgagcaggtgctgaacgttaacgtgcccggcggtaagctgaaccgaggtctgtccgtgccagacacgggaatagccctgcttcagaagcccctgaccgatgagcagtttaagcatctgtctatcttgggatggctcactgagttgctccaagcgttttttctagtctcagacgacatgatggattcttctattacccgacgcggccagccgtgttggtatcgtcaccccggtgtcggcctgattgccattaacgacgcctttatgcttgagagcggtatctatgtcattctgaagaagcacttcagatctcacccggcttacgttgactttctggagctattccatgagaccacctggcagacagagctgggccaactgtgtgacctcataaccgcaccagaggataaggtggatctggataacttctctatggagaagtacatgttcattgtcacctacaaaacagcctattattccttctatctgcccgttgcactggcactgctgtacctggaacttgctactccagagaacctgcaacaaactcacgacattcttatccctctcggtcagtactttcaggtgcaggacgactacctcgatgcctacggcgaccccgctgtgattggaaaaattggaaccgacatccaggacaacaaatgctcctggctgattaaccaggcactgcagcgatgtaacacagagcagcgaaagctcctggacaccgcttatgggcgtaaagactcggagctggaggccaaggtcaaggcgctttacaaggagctggacctcgagaaggtttacaaggagtacgaggagaagaccgtgggggagatccggcgaaagattgcagcaatcgacgagtcgcaaggactcaaaaaggaggtgtttgaggccttcctcggcaagatttacaagcgcactaag

SEQ ID NO: 799 - DNA, 1095 bp, Catharanthus roseus
atgtgcgtgtcatcggctctcgccaacgttggacagcaagtgcagcggcagtccaattccgtcgctgaggagcctctggatcctttcagcctcgttgccgatgagctctcaatcctggctaatcggctgcgatcgatggtggttgctgaggtccccaaattggcttccgctgctgagtactttttcaagctgggtgttgaaggaaaacgtttccgcccgacagtcctcctgcttatggcgactgctattgatgctcccatctctcgaactccgcccgacacctcccttgacaccttaagcaccgagttgcgactgcgacaacagtcgatcgccgagatcacagaaatgattcacgttgcaagcctgctccacgacgacgttcttgacgatgctgaaactcgacgaggaatcggatctctcaacttcgtcatgggcaacaagctggccgttctggccggtgattttctcttgtcccgggcctgtgtggccctcgcttctctcaagaacaccgaagtcgtttcgctcctggctactgtcgtggagcatcttgtcactggagagactatgcagatgaccaccacttctgaccagcgatgttctatggagtactatatgcagaagacctattacaagaccgcctcactgatctctaactcgtgtaaagccatcgccctgctggctggtcaaacatccgaagtcgcaatgctggcctatgaatacggcaagaatctgggtctggcctttcagcttatcgacgacgtcttggattttaccggcacctctgcctcactcggcaagggttctttgtccgacatccgtcacggcattgtcacagcccccatccttttcgccatcgaagagttccccgaacttcgagcggtggtggatgagggttttgagaacccttataacgtggacctggctcttcactaccttggaaagtcgcgaggcatccagagaacgcgagagctggctattaaacacgctaacctcgcatcagacgccattgattcccttcccgttacagacgacgagcatgtcctgagatcgagacgggctttggtagagcttacacaacgagtcattaccagaagg

SEQ ID NO: 800 - DNA, 912 bp, Rhizobium acidisoli
atggacgcaaacagggacacgttcgaaacacgactcaagaacaacgctcgagaaattgaggcacttctggatgccttgctcctccctaacgccctgtccgacgagattgctcggccggagaccctccggagcgctatgcattacgccgtcttgaacggaggaaagcgcctgagaccctttctcgttgttgagtccgcggctctcctgggtggagatgacgaggctgccagacgagttggcgccgctctggaatgtgttcattgttatagtcttgtccacgatgatcttcctgccatggacgacgacgacctgcgtcgtggcaagcctaccgtccacatcaaatttgacgaagccacagctattttggccggtgacagcctcctaacctatgccttcgacattatcgccgcccctgagacagccctggccgacacgtcgaaagcttctctggtcctcgctcttgcccgagctgctggtctaggtggcatggcaggaggccaggccctcgatttggctgcggagaagcaggcccccgatgaggccggaattatcagactgcaggctatgaagaccggtgcattgatcagatttgcttgtgaggccggcgctctcatagccgcttccccccccgaagatcgtcgcagactgagagctttcggagagaagatcggcctggcctttcaactggccgatgacatcttggacctgacaagcgatactgccactatgggcaaagctaccggtaaagatgcggccagaggaaaaggaacccttgtggccctgcacggaattgagtgggcggaggagcagctgagacaacatgtccgagatgccgaggctctgctcgcgccctatggtgctcgagcttctacgctgatcgcagctgcacattttatcgcggatcgaaagtct

SEQ ID NO: 801 - DNA, 897 bp, Escherichia coli
atggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 802 - DNA, 897 bp, Escherichia coli
atggatttccctcagcagctcgaagcctgcgtgaagcaggccaaccaggctctgtccaggtttatcgcgcccctgcccttccaaaacactcctgttgtcgagaccatgcagtacggtgctcttcttggtgggaagaggcttcgaccattcctagtgtacgccaccggtcatatgtttggagtttccaccaacactctggacgcccccgcagccgcagtggagtgcatccacgcttattccctaatccacgatgatctgcctgccatggacgacgacgacctacgtaggggcctgcccacttgtcatgtgaagttcggagaggccaacgcgatcctcgccggtgacgccctgcagactctagctttctctatcctatctgacgctgacatgcctgaagtctctgaccgcgaccgaatctccatgatttcggaactcgcttcggcctcgggaatagcaggaatgtgcggcggccaggcccttgacctcgacgctgagggtaagcatgtaccgctggatgctctcgaacggatccaccgtcacaagactggtgctcttatccgagccgccgtgagacttggcgctctcagcgccggagataagggaaggagggcgctcccggtattggacaagtacgctgagtcgatcggtctggctttccaagtgcaggatgacatcctggatgttgtgggcgacaccgccacgctcggtaagcgtcaaggagccgaccagcagctcggcaagtctacctatcctgccctcctcggacttgaacaagctcggaagaaagctcgagatctaattgatgacgcccggcagtctctaaagcagctggccgagcagtccctggacacgtctgccttggaagcccttgcggattacattatccagcggaacaag

SEQ ID NO: 803 - DNA, 912 bp, Brucella suis
atggagaaactgccagtggattttaccaccctgctgaatcgccgtgctatggaagttgaggctgccctggccggattgctggatgagtgcccccggactggagagatcgcaagaccgcaacgcctgatcgccgctatgcgacacggtgtccttaacggtggtaagagacttagacctttcctcgtgctcgagtcggcggccctcttcggccagtacggtcaggctgtcctccgggttgcagctgctttagagtgtatacattgttactcccttgtccatgacgacctgcccgctatggatgacgacgatctgcgacgaggtcagcctactgtgcataaggccttcgacgaggcggctgccattcttgcaggcgactcacttctcacatacgcctttgacatcattgcctctgatgagactgaactcgacgccacgactcgcatcaaactcgtttgtgccctgacacgagcctctggattgggcggtatggcgggaggccaggcgctcgatttgatggccgagactcgaaagcccgatgaggccggtattattactcttcaggccatgaagaccggagccctgatccgatttgcttgcgaggccggagccattattgcaggagcttctcaggaagaccgagagcgcatggccgagttcggatccgccattggtcttgctttccagctcgctgacgatttattagatgtcacagctgacgcgggtaccatgggtaaggctaccggcaaggatgctgctgccggcaaggcgacccttgtatctctccatggtatcgattggacgagacagcagctgtccggactagtggcccaggctgaatcactcttggcacctttcggcgaagatgccgagcctttgaagcaggccgcacggttcatcgctgagcgacagaac

SEQ ID NO: 804 - DNA, 1017 bp, Arabidopsis thaliana
atgttttctctcgtagccgacgagctgagtctactgtctaacaagcttcgtgaaatggtactggccgaagtgcccaagcttgcatctgcagctgagtacttttttaagagaggggtgcagggaaagcagttccgttctactattctccttctgatggccacggctcttaacgtcagggtgcctgaagccttgattggtgagagcactgacatcgtgacttccgagttgcgggtgcgacagagagggattgccgagattacagagatgatccacgtggcatccctgctgcatgacgacgtcctggacgatgctgatacgcgacggggcgtcggatccctcaacgttgtcatgggaaataagatgtcggtcctcgctggtgatttcctactttcgcgagcatgcggagcgctggcggccctcaagaacacggaggttgttgccctcctggccactgccgtcgagcaccttgtaactggagaaactatggagattacctccagcaccgagcagagatacagtatggactattacatgcagaagacctactataagacagcatctctcatcagtaacagctgtaaggcggtggccgtgttgactggccagacagctgaggtagccgtcctggcctttgaatatggtcgtaacctgggtctcgcattccaactgattgacgacattttggactttactggtacttctgccagtctaggaaagggttccctctccgacatccgacacggagtgattaccgcccctattctgttcgcgatggaggagtttccccagcttcgggaagtggtcgaccaggtagagaaggatccgcgaaacgtagatattgccctggagtacttgggaaaatctaagggaatccagcgagccagagaactagcgatggagcatgctaacttggctgcagccgccattgggagcctgccagagaccgacaacgaggacgtcaagcggtctcggcgcgcgctgatcgacctcactcatcgagttattaccagaaacaag

SEQ ID NO: 805 - DNA, 846 bp, Buchnera aphidicola
atgcacttctttcacctgtatgagcgatacaaacaccgaatcaatcaaaagcttttttacactttgaatcagctgccgtttcagaaatcgtccctgttgaaggcaatgaaatactccgtcttctcaggctctaaacgacttagatcatctctcatctactcaactggtgacgtcttcaaggtgaatattactaccctggacgtcatctccacggccatagaattcattcacagctattctttgattcacgatgacttgccctgtatggataatgacaattttcgacgaggtaagatttcttgccacgtgaagtatggcgagtcgacctctctgctcgccggagacgccctgcaatcgttggctttcaacattttaagcaactcttttatgcctaatgtgagcaacctgaagagaatcaagatgatctccgagctttcttacagcattggctcttcgggtatgtgtatgggccaaaacctggatctggaggcggagaagaaggacgtgaacctgtcagagttggagattattaacttgtacaagacttcttttctaatgcgatctgctgtgcggcttgtctactttagctccaacaacttttccaagtcgatcctgtccatcctggatctgttcagcatctcgattggcctggcctttcaaattcaagatgacatcctcgactttaagaaggatagcgtcaagaccgataacaagaaaattatcaagaagcatacttaccccttgatcatcggtcttgacgagagtcggaagaagatcaagcaattgcataagaagtccttccttgccctcaactctttgaaaaagaagatctctattcccacttac

SEQ ID NO: 806 - DNA, 1065 bp, Dendroctonus ponderosae
atgatcagaccggttcaatcatcagccctagtgacaaaggaacaatcgagagacttcatggctctctttcctgaccttgtgcgagagctgaccgaggtgggcaagtcgcaggagctcccagacgttatgcgacgattcgctcgtgttctccagtacaatacacccaccggaaagaaaaaccgtggcttgatcgtgctgtccacttacagaatgcttgaagaccccgagaagctcacccccgaaaacatccgtctagcttcaattctcggatggtgtgttgagatggtgcacgcctacttcctcatcttggacgacatcatggacggttccgaaactcgaagaggtgcattatgctggtttcgacagtcgggcatcggacttaccgctgttaacgacgctgtaatgatcgaaaacgccgtttacctgctcatcaagcgacacctaaaagaccaccccatgtacgtgcccctcatggaactgtttcacgagggcaacctgaaaaccactctaggacagtctctggacgcaatgtgtctcgacaccaacgggaagccgaagctggatatgtttacgatgagccgatacacttctatcgtaaagtacaaaactgccttttactccttccaaatgccggtagctatcgcaatgtacctggctggaatgtctgacgaggagcagcatcgacaggcaaagacaatactgatggaaatgggacagttcttccagatccaggacgatttccttgattgcttcggcgatccgaccgtaaccggcaaagtgggtactgacattcaggacggcaagtgcagttggcttgccgttgtggcgctccagcgcgcctcccctgcacagcgtaaaattatggaggaacattacggcagacctgagccagagtctattgctcgaatcaagaacctctacgtggacctgtgcctcccaaacacgtacgccatctacgaagaagagtctttcaacattatcaagacccacatccagcagatttccaaaggactgaggcacgacctcttttttaagataatggagaagatctacaaacgagagtgc

SEQ ID NO: 807 - DNA, 942 bp, Picea abies
atgaaggcgctcgtccaactggcagacctgtcagagcaggtgaagaacgtcgtcgagtttgacttcgataagtatatgcactcgaaggctatcgctgtcaacgaggccctggacaaggtaattcctccgcgataccctcagaaaatctatgaaagcatgcgatactctctgcttgcaggtggtaagcgagtccgcccgattttatgtatcgccgcctgcgagcttatgggaggcacagaggagttggctatgcccacagcctgtgcgatcgagatgattcacaccatgagcctgattcatgacgacctgccctacattgataatgacgacctccgaagaggaaaacctaccaaccacaaggtctttggagaggatactgccataattgccggcgacgcccttttgtcgctcgctttcgagcatgtcgccgtttctacctcccggactctgggtaccgatatcatccttcgtctcttgtctgaaattggacgagccacgggcagcgaaggcgtgatgggaggccaggtggtggacatcgaatcagagggcgacccctccatcgacctggagacgctggagtgggtccacatccacaagacagctgtgttgctggaatgttcggtggtgtgtggagccatcatgggtggcgcgtctgaagacgacattgagcgagcacgacgatacgctcgctgtgtcggactccttttccaggtggtggacgacatccttgacgtttcccagtcttccgaggaactcggaaagaccgccggtaaggatctcatttccgacaaagcaacgtatcccaagctgatgggactggagaaggcaaaggagtttgctgacgaactattgaaccgaggcaaacaagagctctcctgctttgatccaactaaggccgcacctctgttcgcgttggcggactacatcgcatctcgacagaac

SEQ ID NO: 808 - DNA, 900 bp, Abies grandis
atgaaggctgttgagttcgacttcaacaagtacatggactctaaggccatgacagtaaatgaggctctcaacaaggccatacctcttcggtacccccagaagatctatgagtcaatgcgctatagcctgctggctggaggcaagcgggttcgacccgttctgtgtatcgctgcttgcgagttggtcggaggcacggaggagctagctattcccactgcttgcgctattgagatgatccatacaatgtcgctgatgcatgacgacctcccctgtattgacaatgacgacctgcgacgaggaaagcctactaatcacaaaatttttggagaggacacagcggtcacagccggcaacgccctgcactcgtatgccttcgaacacattgccgtgtctaccagtaaaaccgtaggtgcggaccgtatcctccggatggtgtccgagcttggacgtgctacaggatctgagggcgttatgggaggacagatggtcgacatcgcgtctgaaggagatccttcgatcgacctacagacccttgagtggattcacatccacaagaccgctatgctcctggagtgttcagttgtgtgtggtgcgattataggtggcgcctcggagattgttatcgagagggcacggcggtacgcccggtgtgtgggactgctattccaggttgtggacgacattctcgacgttaccaaatcgtccgacgaactcggtaagaccgcgggtaaggacctgataagcgacaaggccacgtaccccaaacttatgggccttgagaaggctaaagagttctccgatgagctgcttaaccgagctaagggagagttgtcgtgcttcgaccccgtcaaggcggcccctctgcttggtctcgccgactacgttgctttccgtcaaaac

SEQ ID NO: 809 - DNA, 1113 bp, Corynebacterium glutamicum
atgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 810 - DNA, 1041 bp, Vitis vinifera
atgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 811 - DNA, 957 bp, Picea abies
atgttgcgatgtagcaatacaaatgcacagctggctaacctctccgagcaggtgaagggaaaggtgactgagtttgattttaaagagtatatgcgatctaaggcaatgtccgtgaatgaagctctggatcgcgctgtgcccctacgataccccgagaagatccacgaggccatgagatattctctactggctggaggaaagcgagtccgacccatcctctgcatcgccgcctgcgaactggtcggaggctcggaggaactagctatgcccactgcttgcgcgatggagatcatccatacgatgagcctcatccacgatgacctcccacccatggataacgacgacctgcgtcgaggaaaaccaacgaaccacaaggtgttcggcgaggggaccgcggtgctggccggagatgcgcttttatcattcgctttcgagcacatcgccgtctctacctctaaaacggtggagagtgaccgagtcctcagagtcgtctcggaacttggacgtgccatcggaagtgagggcgttgcgggtggccaggtcgctgacattacttcccagggaaacccatccgtcggcctggagaccttggagtggattcatattcacaaaactgccgttttactcgagtgtagtgtggcctctggagcgatcatcggaggcgcttctgacgacgaaattgaaagggtccgcaagtacgcgcgatgcgtcggactcctgtttcaggtggttgacgacatcctcgacgtcactaagtcctccgaggagctcggaaagaccgctgccaaggacctcttgtctgacaaggccacataccccaagttgatgggcctggaaaaggctaaggagttcgccgatgaactgttgggcaaagctaaggaggagctcagtttctttaaccccactaaggcagcccccctattgggcctggcggactacatcgctcagaggcaaaac

SEQ ID NO: 812 - DNA, 957 bp, Picea abies
atgctgcgatgctccaacactaacgcccagctcgccaacctgtcagagcaggtcaagggcaaggtcactgagtttgatttcaaagagtacatgcggtctaaagctatgagtgtcaacgaggctctggatcgagccgtgcctctgcgataccctgagaagattcacgaggccatgcgatacagtctgttggctggtggcaagagggtgagacccatactgtgcattgccgcctgcgaactggttggcggatctgaggagctcgccatgccaacagcctgcgcgatggagattattcacacttactcccttatacatgacgatctccctcccatggataacgatgatctgcgacgaggtaagcccacgaaccataaggtgttcggtgaaggaaccgccgttctagccggtgatgcactgctttccttcgcctttgaacacatagccgtctctacttcgaagaccgtggagtccgacagggtgctccgagttgtcagcgagctagggcgagctattggatctgagggtgtcgctggtggacaggttgctgatattaccagccagggaaacccgtccgttggcctggagactcttgaatggatccacattcacaagacggccgtgcttctggagtgcagtgtggcgagcggcgcaatcattggcggagcctccgatgatgagatcgagcgcgtgcgaaagtatgcacgctgtgtcggtctcttgttccaagtggtggatgacattctggacgtcactaagagctcggaggaactgggcaagacagctgctaaggatttactctccgacaaggccacctacccaaagcttatgggcctcgagaaagccaaggagttcgccgacgagctcctgggaaaagcgaaggaggaactgtctttctttaaccctacaaaagcggctcccctgctcggactagccgattacattgcgcagagacagaac

SEQ ID NO: 813 - DNA, 1059 bp, Sus scrofa
atgaacggagaccagaagcttgacgcctatgcccgagagcgacaggatttcattcaacatttctcccaaattgtgaaggttctgactgaagaagatatcggacatcccgagattggcgatgccgtggccagactcaaggaggtcttggaatacaacgtcgtaggcgggaagtacaacagaggaatcactgtgctagttgtctttcgagagctcgtggagccgcgaaagcaggacgctgactcactacagagagctctcacggtgggatggtgcatcgaactgctccaggctttctttctcgtcgccgatgacattgaggactcctccctgactagacgaggtcagacatgctggtaccgaaagcccggtatcggactcgacgccattaacgatgccttcctcctcgaggcttgtatctaccgcctgctcaagttttactgccgagaacaaccgtactacttgaatctcattgagcttttccttcagacttcttacaacaccgaaatcggtcagacactggatctaattgccggtccccagggcaacgtcgatctgtcacggtttactgagaagcgatacaagtccattgttaagtacaagactgctttctactccttttatcttcctgtggctgccgccatgtacatggctggcattgacggcgagaaggagcacgctaacgcaaaaaaaatccttatggaaatgggagagttttttcagatccaagatgattaccttgatctgttcggcgatccttccgttacaggtaagatcggaaccgacattcaggataacaagtgcagttggttagtcgtgcaatgcttgcaacgtgctagcccagagcagaggcaaattctgcaagagaactacggtcagaaggacgccgagaaggtcgcccgagtcaaagctctgtatgaggagatgaacctgcaggccgtgttcctacagtacgaggaagattcgtattcccacctgatgggactcattgaacagtacgccgctcctctccccccggccattttcctcgagctagcccataagatttacaaacgacgaaag

SEQ ID NO: 814 - DNA, 1059 bp, Acyrthosiphon pisum
atgcccgttattacggggacggcggtctccaaggatgagacgcgtgacttcatggctgtgttccccgatgtcgtccgggatttgacagacaccggcagaaacctcgacgtccccgacgttacaaaatggctagcgaagctcctccagtacaacgtgcccggagggaagaagaatagaggtctcgctctcgtcctgagttataagatgctgtcctctccagcagaccagactgatgagaacatccggctgtcttacatcttgggatggtgcgtggaaattcttcaggcttatcagctagtcctagatgacattatggataacgcgattaccagaaggggccgaccttgctggtaccgacacaatgatattggcctcatggccgtcaacgatggagtgctccttgagcaatctatctatcagctcataaagaagtacttcaaggacaagccgtactacactcacattctggagttgttttacgatgtgaccatgaaaacgtcgatgggacagtgcctggacatgctgaccgccaattcttttaaatcgaaaaagctcgagaagtacaccatggagaactacactgccattgttaagtacaagactgcttactactctttttttctgcccgtctgcctagcgatgagaatgaccaacatcaacgaccccgaaatcttcagacaggccaaaaccattcttctcgagatgggccatttttttcaggtccaagatgactttttggactgctacggcgatccggacgtcatgggcaagatcggaaccgatattgaggacggaaagtgtagttggctcgccgtcgtagccctgcagaaggtcaactccgagcagaagaagattatggaagacaattatgggattgataacccggcgaatgttgcagtgatcaaagatctttacgcacaattgaaactgcccgataccttccatttatatgaggaggaatcctacaagctgatttgcacccatatccagcagctctcgcgtggactcagtcaggacatgttttttaaatttctggaaaaaatttacaagcgaactctc

SEQ ID NO: 815 - DNA, 1077 bp, Mycobacterium tuberculosis
atgcgaggcaccgacgagaagtacggactgcccccccagcctgattcggatcgaatgacccgaagaacactccctgtgctgggtctggctcacgagctcattacgcctacactgcgacagatggcggatcgtcttgacccccatatgcgaccagttgtttcataccaccttggctggtctgacgaacggggtcgccccgttaataacaactgcggtaaggccattcggcctgcgttggtttttgtggctgccgaggctgcaggagccgatccgcattccgccattcccggtgctgtctcagtggaactggtccacaactttagtctggttcacgatgatcttatggaccgagatgagcaccgacgacatagaccaaccgtctgggccctgtggggcgatgccatggcccttttggccggtgatgccatgctctcgctcgctcacgaggtcctgcttgactgtgattcccctcacgtcggagccgctctccgagccatttctgaggccacacgggagcttatccgcggacaggctgcagataccgcatttgaatcgcgaacagatgtggctttagatgagtgtctgaagatggcggagggcaagactgctgcactgatggccgcttccgccgaggtgggtgcccttttagcaggagctccccgttctgtgcgagaggccttggtcgcctacggacgccacatcgggctcgcgttccagctcgtggatgaccttctgggcatttggggccgacctgagatcactgggaaacccgtttactccgacttgcgatctcggaagaagaccctgcccgttacgtggaccgttgctcacggcggactcgccgggaggcgcttggcggcttggctggtcgatgagaccggctcgcagacagctagcgacgacgagctggccgccgtggccgagcttattgagtgcggcggagggcgacggtgggcttcggccgaagctcgccggcacgtcacccaaggcattgacatggtggctcggatcggaattccggatagaccagccgccgagttgcaggaccttgcgcactacattgtggacagacaagcc

SEQ ID NO: 816 - DNA, 879 bp, Staphylococcus aureus
atgactaacctgcccatgaataagctcattgatgaggtcaataatgagctgtccgttgccatcaacaagtccgttatggacactcagctggaggagagcatgctctactccctgaatgccggaggtaagcgtattagacctgtcctcttgctgttgacactcgacagcctaaacactgaatacgagctgggaatgaagagcgcgatagctctggagatgattcacacctattcgctgatccacgacgacctacctgcgatggacaacgacgattaccgaagaggtaaacttactaatcataaagtgtacggcgaatggacggctattctggccggcgacgctctgctgactaaggcattcgaactgatttcctcggacgaccgtctgaccgatgaggttaaaattaaagtgttgcagcgactgtctatcgcctctggccacgtcggaatggtcggaggccagatgttggatatgcaatctgaaggccagcctatcgacctcgagacgctggagatgatccataagacgaagaccggcgctctgctaacttttgccgtcatgtcggctgctgacattgccaacgtcgacgacacaaccaaggagcaccttgaaagttactcttaccatctcggcatgatgttccagatcaaggatgatctgcttgactgttacggcgacgaggcaaagctgggtaagaaggtcggttcggatcttgagaacaacaagtccacatacgtctccctgctcggcaaggacggcgcagaggacaagttgacataccatagggatgcagccgtcgacgagctcacccagattgacgagcaattcaataccaagcacctgctcgagattgtcgacctcttctactctcgtgaccat

SEQ ID NO: 817 - DNA, 891 bp, Geobacillus sp.
atggcccaactgtccgtcgagcagttcttgaacgaacagaagcgtgctgttgaggcagctctgagcagctacatggctcgactcaggggtccggagacattgaagaaagccatggcctattctcttgaggccggtggcaagcgcatacggcctctgctgcttctggcaactatacaggctttgggcaaagaccccgcaatcggactgcctgtggcttgtgctatcgagatgatccacacctactcgctcatacacgatgacttgccttctatggataacgacgacctgcgccggggcaaaccaaccaatcataaggtgttcggtgaggctatggcgatcttggcgggagatgcactgcttacatatgcttttcagcttatcgcagaggtcgacgacgacagagtgcccccatccgtccgactccagctcattgagcagttggccaaggcggccggtcctgagggcatggttgctggccaggccgctgacatggaagccgaggggaaaaccctcgccctagcggagctggagtacattcacagacacggaacgggaaagatgctgcaatactcggtgcatgctggtgctctgctgggtggagctgacggcagacagactcgggagcttaatgagtttgctgctcacctgggtctagcctttcagattagagacgacattttggacatcgagggcatggaagagaaaatcgggaagcgagttgggtctgatcgtgacaataagaaggcaacctaccccgtgctgctttccctgggtggagccaaggaaaagctcgcgttccatatcgacgccgctaagagacatctacagcaggccaagattgacgacgccgtgcttgcctatatctgcgaactcgtcgctgttagggatcac

SEQ ID NO: 818 - DNA, 1056 bp, Saccharomyces cerevisiae
atggcctccgagaaggagattcgccgtgagcgcttcttaaacgtcttccctaaactggtggaggaactgaacgcaagtctcctggcttacggcatgcccaaggaggcctgtgattggtacgcacacagcctgaattataacactcctggaggaaagctgaaccgcggactctcagtcgtggacacatacgctatcctgtcgaacaagaccgtcgagcaacttggccaggaggaatacgagaaggtcgccatcttaggatggtgtattgagcttctgcaggcgtatttcctagtggccgatgatatgatggataagtctatcacccgaagaggtcagccttgctggtacaaggtgcccgaggtaggagagattgcaatcaacgacgcctttatgctggaagccgcgatttacaagctcctcaagtcacacttccgaaatgagaagtactacatcgacatcaccgagctctttcacgaggtgacgttccagacggaactcggacagctgatggatctcataactgcgcctgaagacaaagtggacctgtccaaattctctctcaaaaagcattcgttcatcgttaccttcggcaccgcctactacagcttctacctgccagttgctctggctatgtacgtggccggcatcaccgacgagaaagatctcaagcaggcccgcgacgtcctaattcccctcggcgagtattttcagattcaggacgattaccttgactgcttcggaacccccgagcagatcgggaaaatcggaaccgatatccaggacaacaagtgttcttgggtcatcaacaaggccctggaactggcatctgctgagcagcggaagacacttgacgagaactacggcaaaaaggattcggttgccgaggccaagtgtaagaagatctttaatgatctgaagattgaacagctctaccatgagtacgaagagtcgatcgccaaggatctgaaggccaaaattagtcaggttgacgaaagcaggggtttcaaggcggatgtgctcaccgccttcctgaacaaggtttacaagagatctaag

SEQ ID NO: 819 - DNA, 1041 bp, Neosartorya fumigata
atggccaccacaacttcccgagccgcattcgaagctgtgttccctacccttgcagaagacctgttggcgcatgcaaaaaaatataacctgcccgagaacgctgtgaagtggtttgaacaagttcttaacgttaacgtacccggaggcaagctgaatagaggactttcagtgcccgacaccggtattgccctccttcaaaaaccccttactgacgaacagtttaagcacctgtcgatccttggctggctcactgagctactgcaagcgttcttcctggtaagcgacgacatgatggattcttccattacccggcgaggccagccttgttggtaccggcatccaggtgtaggcctgatcgccattaacgatgcatttatgctagaatctggaatttacgttatcctcaagaagcatttccgatcgcatccggcatatgttgacttcctggaactgtttcacgaaacgacctggcagacagagctcgggcagctctgtgatctgattactgcccccgaggacaaggtggatctggataacttctccatggagaagtacatgttcattgttacctacggcaccgcgtactacagcttctatttgcccgtggcactagccctcctgtatctagaactggcgacccccgagaacctgcagcagactcacgacatcctgatccccctgggacagtacttccaggtgcaggacgattatcttgatgcctacggtgacccagccgtcatcggcaagattggcaccgacatccaggacaacaaatgttcgtggctgatcaaccaggctctacagcgatgcaacaccgagcagcgaaagctcctcgacactgcctacggccgaaaggactctgagctggaggccaaggtcaaagctctgtacaaggagctggacctggagaaggtgtacaaggaatacgaagaaaagactgtgggcgagatccggcggaagattgccgcgatcgacgaatcacagggacttaagaaggaagtgttcgaggcctttctgggtaagatttataagcggaccaag

SEQ ID NO: 820 - DNA, 1041 bp, Neosartorya fumigata
atggctactaccacatcaagagcagccttcgaggccgtgttccccacccttgcggaggacctgctagcgcacgccaaaaagtacaaccttcccgagaacgccgttaagtggttcgagcaggtgctcaacgtcaacgtgccgggcggaaagctcaacagaggtctctcggtccctgataccggcatcgcgctgctccagaaacccctgacggatgagcagttcaagcaccttagcattctgggctggctaactgagttgctgcaagctttttggctcgtgtcagatgatatgatggactcctccatcacgcggcgaggacagccctgctggtaccgtcaccctggcgtgggccttatcgccatttgggacgcgtttatgttggagtcaggaatctacgtgatcctaaaaaagcacttccgatcccaccccgcttacgtggactttttggagctctttcatgagactacctggcagacagagttaggacagctgtgcgacctgattacagccccggaagacaaggtcgacctagataacttctctatggaaaagtacatgttcatcgtcacctataagaccgcttattactctttctacctgcccgtcgctctcgcactcttgtacctggagcttgcaactcctgaaaacctccagcagacgcacgacatcctgatccccctggggcagtatttccaagtccaagacgattacctcgacgcttacggagatcccgcagtcattggcaagatcggcacagatatccaggacaacaagtgctcttggctgattaaccaggccctgcagcgctgtaacaccgaacagagaaagctgttggatactgcatacggtcgtaaggactctgagttggaagcgaaggtgaaagctctgtacaaggagctggatctggagaaggtatacaaagagtacgaggagaagacggtgggcgaaatccgacgtaagattgctgctattgatgaatctcaaggtctcaagaaggaggtcttcgaagcattcctcggtaaaatttacaagcgcacaaaa

SEQ ID NO: 821 - DNA, 1095 bp, Catharanthus roseus
atgtgtgtctcatcagccctcgctaacgtcggacaacaggtgcagcgacagtccaactcggttgccgaggaacctctggatcctttcagtctagtggctgacgagctgtcaatcctggcaaaccgactgcggtccatggttgtcgctgaggttcccaaactggcctccgccgcagagtatttctttaagctgggggtcgagggcaaacgattccgaccaaccgtccttttgctcatggctacggccatcgatgcccctatcagcagaactcctcccgatacgtccttggatacactatccactgaactgagactccgtcaacagtcgatcgccgagattactgagatgattcatgtggcttccctgctgcatgacgatgtcctggacgatgctgagactagacggggcattggaagcctgaacttcgtcatgggaaacaagcttgctgtgctcgccggcgatttcttgctttccagagcttgtgttgctctcgcgagtctgaaaaacacggaggtcgtaagccttctcgcgactgtggttgagcatctggttaccggagaaaccatgcaaatgaccactacaagcgatcagagatgttccatggagtactacatgcagaagacatactacggtaccgcaagtctcatttcaaactcgtgcaaggccattgctttgcttgctggacaaacctctgaagtcgccatgctcgcttacgaatatggtaagaacctgggtctggcattccagctcattgacgacgtcctagacttcacgggaacgtccgccagcctgggtaagggttccctgtctgacatccgacatggaatcgtgaccgctcccattctctttgcgatagaggagttccccgagctgcgtgctgtggtggatgaaggattcgaaaatccctacaacgtcgacttggcccttcattacctcggaaaatctcgagggattcagcggacccgtgagctagcaatcaagcatgccaacttggcctctgatgctattgactccctgccggtcacagatgatgagcacgtgctgcgatctcggagagctctcgtcgaactgacccaacgagttattacacgacga

SEQ ID NO: 822 - DNA, 912 bp, Rhizobium acidisoli
atggacgccaaccgagacacgttcgagaccagattgaagaataacgctcgagagatcgaggctctgttggatgctcttctcctgcctaacgccctatccgacgagatcgcaagacccgaaaccctccgcagtgctatgcactacgcagtacttaacggtggtaagcgactccggcctttccttgtggttgagtcggctgccctcctgggaggagatgatgaggctgcccgaagggttggcgccgcccttgagtgcgtccattgctattccctagtccatgacgatctgccagccatggacgacgatgacctgagacgtggtaagccgaccgtgcacatcaagtttgacgaggccaccgccatactggctggtgactctttgctcacatacgcttttgacattatcgccgctcctgagactgccctcgccgatacctctaaggcatcgctggtcctggcgctcgcacgagccgcaggtctcggcggcatggcgggcggccaggcactagatctggctgcagagaagcaagcaccggacgaggcgggtattatccgactgcaggctatgggaaccggggctttaatccgattcgcctgtgaagccggcgctctcattgccgccagtccccccgaagaccggcgacgacttagggcgttcggagagaagatcggactggcctttcagctggccgacgacattctagacttgacttccgacaccgcgactatgggcaaggccacgggcaaggatgcggctcgcggcaagggtactttggtcgcactgcacggcatcgagtgggcagaggagcagttgcgacagcatgttcgagacgcggaggctctcctagctccctatggagcccgcgcgagcactctgatcgccgccgctcactttatcgctgatagaaagagc

SEQ ID NO: 823 - DNA, 897 bp, Escherichia coli
atggactttccgcaacagttagaggcttgtgtgaagcaggccaatcaagcgctctctcgcttcatcgccccccttccttttcaaaatacccctgtagtcgaaaccatgcagtacggagcactgctaggcggaaagcgactgcgcccgttcctcgtgtacgcgaccggtcatatgtttggcgtgtctacgaacaccctcgacgctccggccgctgccgttgagtgtattcatgcttacagccttatacacgatgacttgcctgctatggatgacgacgaccttagaagaggactgcctacctgtcatgtcaagttcggagaggcgaatgccatacttgccggagatgctctgcagaccctcgccttctctattttgagcgatgcagacatgcccgaggtgtcggatcgagacagaatctccatgatctcggagctcgctagtgcttcaggtatcgctggtatgtgtggtggacaggcacttgaccttgatgccgagggtaagcatgttccactggatgccctcgagcggatccacaggcataagacaggcgcactcatcagggctgccgtgcgactcggtgccctgagcgcaggtgataaggggcgccgtgctctgccggtgcttgacaagtacgccgagtcgattggtctggctttccaagttcaggacgatatcctcgatgtcgtcggcgataccgccactctgggtaaacggcagggagccgaccaacagctgggcaagtccacatatcccgcactgctggggctcgagcaagcccgaaagaaggcacgcgacctaattgacgatgcgcgacaaagtctaaagcagctggctgagcagtctttggacacgtcggccctcgaggccttggctgattacattattcagcggaacaag

SEQ ID NO: 824 - DNA, 912 bp, Brucella suis
atggagaagctccccgtggatttcacgacactgctaaaccgaagagctatggaggtcgaggctgccctcgctggtctgctcgacgaatgtcctcggacgggtgaaatcgcacgacctcagcgactgattgccgctatgcggcatggagttctgaatggaggtaaacggcttcggccttttctggtcttggagtcggccgctctcttcggccagtatggtcaggccgttctgcgcgtcgcagctgccctggagtgcattcactgctacagcttggtccacgatgatttgcccgctatggatgacgacgacctgcgaagaggacagcctactgtccataaggcttttgatgaggcagcagctatcctggccggtgattcgcttctgacgtacgctttcgacattattgcgtccgacgagaccgaactggacgccacgacgagaattaagctggtctgtgccctgaccagagcctcgggcctcggcggaatggcaggtggtcaggccttggatctgatggctgagacgcgtaagccagatgaggccggaatcattacccttcaagctatgggaaccggtgctctgattcgattcgcgtgcgaggctggagctattatcgctggcgcttcgcaggaggatcgagaacgaatggccgagtttggctctgccatcggcctcgccttccagctggccgatgacctcctcgatgtgaccgccgatgctggcaccatgggaaaggcaaccggcaaggacgccgccgccggtaaggcaacgctggtttcgctccatggaatcgactggacaagacagcagttgtctggcctcgtggcccaagccgagtccttgctcgcacccttcggagaggacgccgagcctctgaagcaggccgccagatttatcgccgaacgacagaac

SEQ ID NO: 825 - DNA, 1017 bp, Arabidopsis thaliana
atgttttccctggtggctgacgagctgagtctcttgtctaataaactgcgggaaatggtactcgccgaggtacccaaactcgcctccgctgctgagtacttctttaaacggggagtgcagggcaagcagttccgttccaccatcctactcctcatggctacagccctgaacgtgcgagtccctgaggcgctcattggtgagtcgacggatattgtcacttcagaacttcgtgtgaggcagcgaggcatcgccgaaattactgaaatgattcatgtggcttccctcttgcacgatgacgtcctcgatgatgccgacactagacggggtgtgggctccttgaacgtggttatgggaaataagatgtcagtgcttgcgggcgatttcctcctttctcgggcttgtggcgcactcgctgccctcaagaacaccgaagtggtcgctctgttggccaccgctgtggagcacctggtgacgggcgaaactatggagattacctcttctacagagcagcgttactcaatggattactatatgcaaaaaacgtactacgggaccgctagtcttatctctaactcttgcaaggctgttgccgtcctgactggtcagaccgcagaggtggctgtgcttgcctttgaatacggccgcaacctagggctggcctttcagctcatcgacgacatcctggatttcacaggcacatctgcttccctgggcaagggtagcctctccgatatccgacacggcgtcatcacggcccctattctctttgctatggaggagtttccccaactgagagaggtcgtggaccaggtggagaaggatccgagaaacgtggatattgcccttgagtacctaggtaagagcaagggaatccagcgagcccgagagctggcaatggagcacgctaacctcgctgccgctgctattggctctctgcccgagaccgataatgaggatgtgaagcgatccagacgcgcccttattgacctcacgcaccgagtaattacccgcaacaag

SEQ ID NO: 826 - DNA, 846 bp, Buchnera aphidicola
atgcacttctttcacctgtatgagaggtacaagcaccgaattaaccagaaacttttctacaccctgaaccagcttccctttcaaaaatcctccctgttgaaggcaatgaagtactctgtgttctctggctctaaacggctgcgaagctccttgatttactcgaccggtgatgtgtttaaggtcaacataaccaccctggacgtcatctctactgctattgagtttattcattcttactctctcatccacgacgatcttccctgtatggacaacgataatttccgacgaggcaaaatatcttgtcatgtcaagtacggagagtctacgtctcttctcgccggagacgcgttgcaatccctggcctttaatatcctgtcaaactccttcatgcccaacgtatcgaatctcaagcggattaagatgatctcggagctctcctactccatcggatcctccggaatgtgtatgggtcagaatctggacctcgaggccgaaaagaaggacgtcaacctgtctgagctggagattattaacctgtacggaacctctttcctgatgcgaagcgcggtccggctggtgtacttcagctccaacaacttctcgaagtctatcctttcgatcctcgacctgttttccatttccatcggtctggctttccagatccaggacgacattttggatttcaagaaggactctgtcaagaccgacaacaagaaaataattaagaagcacacatatcccctaattatcggcctggatgagtcccgaaagaagattaagcagctgcacaagaagtctttcctggccctgaacagcctgaaaaagaagattagcattcccacctac

SEQ ID NO: 827 - DNA, 1065 bp, Dendroctonus ponderosae
atgattcgacctgtgcagtcgtcggccctggtcaccaaagagcaatcccgagatttcatggctctgttccctgacctggtgcgagagttgacagaggtcggtaaaagccaagagctgcccgatgttatgcgacgatttgcccgggtcctccagtacaacacccccactggcaagaagaaccgaggcctgatcgtactgtcgacctaccgaatgctggaggacccggaaaagctcacgcctgaaaacatccgacttgcttcaatcctgggctggtgtgtggaaatggtccacgcgtactttctcattttggatgacattatggacggatctgagacccgacgaggtgcactgtgctggttcagacagtcgggcatcggactgaccgcagtgaatgatgcagttatgatcgaaaacgcggtgtacctgctcattaaacgacacctgaaagatcacccgatgtacgtccctcttatggagctgtttcacgaaggaaacctcaagactacactcggacaatctctcgatgctatgtgtcttgacactaacggaaagccaaagttggatatgttcactatgagtcgctacacatcgatcgtgaagtacggaaccgccttttactcattccaaatgccggttgccatcgctatgtatttggctggaatgtctgacgaggagcagcaccgtcaggccaagactatccttatggagatgggtcagtttttccagattcaggatgacttcctcgactgctttggcgatcccaccgtcaccggtaaggtcggaactgacattcaggatggtaagtgtagttggcttgccgtggtcgcactccaacgagcaagtcccgcccagcgaaagattatggaagagcattacggtcgtcccgagcccgagagtatcgcccgaattaagaacctatacgtggacctgtgcctccccaatacctacgcgatctacgaggaggagagcttcaatattattaagacacatattcaacagatttctaagggactgcgacatgaccttttctttaagattatggaaaagatctataagcgagaatgt

SEQ ID NO: 828 - DNA, 942 bp, Picea abies
atgaaggctctggtacagctggccgacctgtcagagcaggtcaagaacgtcgtcgaatttgacttcgacaagtacatgcactcgaaagcaattgccgtcaacgaggcgctcgataaggttatccctccccggtacccgcagaagatttacgaatctatgcgatacagcctcctagccggcggcaaacgtgtgcgacccatcctgtgtattgctgcttgcgagctgatgggcggcaccgaggagctggctatgccgacagcatgtgccatcgagatgatccacaccatgtctctcattcacgacgatctgccttacatcgacaacgatgaccttcgacggggtaagcccacgaaccacaaggtgttcggtgaggacacagcaatcattgctggtgacgccctgctgtccctcgctttcgagcatgtggctgtgtctacctcacgtacactcggcaccgatatcattctacgactgctttccgaaattggtcgagctactggatcggagggcgtcatgggcggccaggtcgtggatatcgagtcagagggcgacccctcaattgacctcgagactctggagtgggttcacattcacggcacagccgtgctcctggaatgctctgtcgtgtgcggtgccatcatgggtggggcgtccgaggacgacattgaacgagcccgccgatacgctcgttgcgtcggattgttgtttcaggttgtcgacgacattttggatgtgtctcaatcgtcagaagaactcggtaagactgccggcaaggacctaatctctgataaggccacttaccctaagttgatgggtctcgaaaaagccaaggagtttgcagacgagcttctcaaccgaggtaaacaggagctgtcctgcttcgaccctacgaaggccgctcccctctttgctctcgccgactacatcgcctcccgacagaac

SEQ ID NO: 829 - DNA, 900 bp, Abies grandis
atgaaggccgtagagtttgactttaacaagtacatggattccaaggcaatgactgtgaatgaggcactcaacaaagccattcccctgcgatacccccagaaaatttacgaatctatgcgttactcgctattggctggaggaaagcgtgtccgcccggtcctctgtattgctgcctgtgaactggtgggcggcacagaggagctggccatcccgactgcctgcgctatcgagatgatccataccatgtccctgatgcacgatgacttaccctgcatcgataatgacgacctaagacggggtaagcccaccaaccataagattttcggagaggacaccgccgtcaccgcaggaaacgccctgcatagctacgcttttgagcacatcgccgtgagtacttccaaaaccgtgggagccgatcgaattcttcgtatggtctccgagcttggtcgagctaccggttcggagggcgttatgggtggccagatggtggacattgcctccgagggtgacccctcaatcgacctacaaactctcgagtggatccacatccacggcactgctatgctgctcgaatgctctgtggtgtgtggtgcgattattggcggcgcgtccgaaatcgtcattgagagagcccgacgatacgccagatgtgtgggcctgttgtttcaggtcgttgacgacattctcgacgtaactaaatcctccgatgagctgggcaagaccgccggcaaagacttgatatcggacaaggccacgtaccccaagctaatgggactggagaaggccaaggagttcagtgacgagctgcttaaccgagcgaagggcgagctctcctgttttgaccctgttaaggccgccccgctattgggattggccgattacgttgcttttcgtcaaaat

SEQ ID NO: 830 - DNA, 1113 bp, Corynebacterium glutamicum
atgaaagacgtgtctctttcgtctttcgatgcccatgacctggatcttgataagttccctgaagtcgtgcgagaccgactcacgcagttcctggacgcccaggagctgaccattgcggatattggagccccagtcacagatgcagtggcccacctgagatcgtttgtgttgaacggcggcaagcgaatcagaccactttacgcctgggccggatttctcgctgctcagggtcataagaacagttccgagaagcttgagtccgtccttgacgcagccgcctcgctcgaattcattcaggcttgcgccctcattcacgacgacatcatcgactcctcggatacgcgacgaggagcacccacggtgcaccgagctgttgaggccgatcaccgtgccaacaacttcgagggtgacccagagcatttcggcgtttccgtctccatcctggccggcgacatggcgcttgtctgggcggaggatatgctgcaggactctggcctctccgcagaggctcttgcacgaactcgagacgcctggagaggtatgcggactgaggtgatcggaggacagttgctggatatctaccttgaaagccacgctaacgagtccgttgagctcgccgactctgtaaaccgctttggtaccgcagcttacaccatcgctcgacccctccacttgggcgccagcattgcaggcggttctccccagctgatcgatgcactcctccactacggccatgacatcggcattgccttccagttgagagatgatctcctgggtgtcttcggcgaccccgcaattaccggaaaacctgctggcgatgacattcgagagggaaagcgaactgttttgttggctcttgctctccagcgagcggacaagcagtctcccgaggccgctaccgccattcgagccggcgtcggtaaggtgacatccccggaggacattgcggtgattaccgagcacattcgtgctacaggtgccgaggaggaggttgaacagcgaatctcgcagctgaccgagtcgggactcgcccacctcgacgatgtggatatccctgacgaggtccgagcgcaactgcgggcactggcgattcgtagtacagagagacgaatg

SEQ ID NO: 831 - DNA, 1041 bp, Vitis vinifera
atgcttgcagaggagcaattggaccctttcagcctcgtggccgatgagctgtccctgctggctgaccggcttaggtcaatggtcgttgcagaagttcctaagctcgccagcgccgcggaatacttcttcaagatgggagttgagggtaagcgttttcgaccaaccgtcctcctcctgatggctacagcccttaacgttcccctaccccgacccgctctcgctgaggttcctgagaccctctccaccgagctgcgaacccgacagcagtgtattgcggagatcactgagatgatccatgtagcctcgctgctgcatgacgatgttttggacgacgccgaaacccgacggggaatcggctccctgaacattatgatgggcaacaaggttgccgtgctcgctggagactttttgctatcccgtgcttgtgtagccctcgcttctctgaagaacaccgaggtcgtcagtctgctggctacggttgtagagcacctggtcactggtgagaccatgcagatgacctctactagcgaacagagagttagcatggaatactacttgcagaagacctactacggaaccgcttcgttgatttcgaactcgtgtaaagccatcgctctgctggccggtcagacagctgaggtgtccatgctggcttttgaatatggaaaaaacctgggactggcgttccaactgatcgatgatgtcctcgactttacgggtacctcggcttccctaggaaagggcagcctgtcggatatcagacacggcatcatcactgctcccatcctgttcgctattgaggagtttccccaactggatgctgtcgtgaagcgaggtctggataacccggccgacatcgacctcgctcttgactacttgggcaagtctcgaggcattcagcggactagagagctcgctatgaagcacgcgaacctggcggctgaggcaatcgactctttgcccgagagcggagatgaggacgtgttgagatcgagaagagccctgattgacctcacccaccgagtgattactcgtaccaag

SEQ ID NO: 832 - DNA, 957 bp, Picea abies
atgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 833 - DNA, 957 bp, Picea abies
atgcttcggtgcagcaacaccaatgcacagctcgccaacttgtcagaacaagtgaagggtaaagtgacggagtttgatttcaaagagtacatgcgaagcaaggccatgtctgtgaatgaagctctagaccgagccgttccactgagatacccagagaagatccacgaggcaatgcggtattctctgctggctggcggcaagcgggtcaggccaatcctctgtattgctgcctgtgagctcgtgggaggctctgaggagctggccatgcccaccgcttgtgctatggagatcattcacacgatgtccctcatccacgacgaccttccccccatggataacgacgacttccggcgaggtaagcctacaaatcacaaagtctttggagagggtaccgccgtcttggccggtgacgctctcctctcgttcgcatttgagcatattgccgtgtccacctcgaaaaccgttgaatctgaccgggtgctccgagtcgtgtcagagcttggccgggccatcggctccgagggagttgccggaggacaggttgctgatattacctctcagggaaacccttccgttggcctggaaactcttgagtggattcacattcacaagaccgccgtccttcttgaatgctccgttgcctcgggagccattattggcggtgcctcagacgatgagatcgagcgtgtccgaaagtacgctcgctgcgtcggcctgctgttccaggttgtagatgacattctggacgtgactaaatcctcggaggagctcggaaaaaccgcggccaaggatctgctatctgacaaagctacttaccccaagctcatgggtctagaaaaggctaaggagttcgctgacgaactcctcggcaaggccaaagaggagttgtctttcttcaatccaacaaaggctgctcctctgttgggactggcggattacatcgcccagcgacagaac

SEQ ID NO: 834 - DNA, 957 bp, Picea abies
atgctccgatgttccaacacaaatgcccagctagccaacctgtctgagcaggtcaagggaaaggtcactgagtttgactttaaggagtatatgagatcgaaggctatgagcgttaacgaggccctggatcgagccgtccctctacgataccccgagaaaatccacgaggctatgcgttactctctcctggcaggaggtaagagagttcgacccatcctttgtattgcggcatgtgagctcgttggaggttctgaggagctagcaatgcccacagcatgcgccatggagatcatccacacaatgtctctcattcacgacgacctcccacccatggacaacgacgatctgagacggggcaagcccactaaccataaggtttttggcgagggaactgccgtgctggccggcgatgccctgttgtctttcgcgtttgaacatattgctgtgtcaacatctaagactgtcgagtccgaccgtgttctgcgcgtggtaagtgagttgggtcgtgcaattggttccgaaggcgtagctggcggacaagtggccgatatcacctcgcagggtaacccttctgttggcctggagactcttgagtggattcacattcatggtaccgccgtactgttggaatgctctgtggcttcgggcgcaataattggcggcgcctcagacgatgagatagagcgagtcagaaaatacgctcgctgtgtgggactgttgtttcaggttgtggacgacatcctcgacgttacgaaatcgtccgaggaactgggaaagaccgctgccaaggacctgctctctgacaaggctacgtaccccaagctgatgggactggaaaaggctaaggagttcgccgatgagctcttgggcaaggctaaggaagagctgtcgttcttcaacccgaccaaggccgcccctttgctcggtcttgcagattatattgctcagcggcagaac

SEQ ID NO: 835 - DNA, 957 bp, Picea abies
atgctccgatgctcgaacaccaacgctcagcttgcaaacctatcagagcaggttaagggcaaggtaaccgagttcgactttaaggagtacatgcgatctaaggcaatgtcggttaacgaggccctagacagagctgtccccctgcgataccccgagaagattcacgaggcaatgcgctattccctgctcgccggaggtaagcgagtcagacccattctctgtatcgccgcctgtgagctggttggtggttcggaggagctagctatgcccactgcttgtgccatggaaatcattcacaccatgagcctcattcatgatgacctcccccccatggacaacgacgatttgcgaagaggtaagcccaccaaccacaaagtctttggtgagggaaccgccgtgctggcaggagacgccctcctttccttcgcgtttgaacatattgccgtgtccacctccaagactgtcgagtcggacagagttcttcgagtggtgagcgagctgggacgcgctattggctcggagggcgtggctggcggtcaagtggccgacatcaccagccagggcaacccctccgtgggattggagacgctcgagtggatccatatccataaaacagccgtgctgtttgaatgctctgtcgccagtggtgctatcattggaggtgcgtccgatgatgagatcgagcgagtccgaaagtacgctagatgtgtgggactgttgttccaggttgttgatgacattctcgacgtgacgaagtcgtccgaggagctcggcaagaccgctgccaaggatctgctttccgacaaggctacatacccgaagctaatgggactggagaaggccaaggaatttgccgacgaattgttgggcaaggctaaggaagagctgtctttcttcaatcctactaaggctgctcctttgctgggtctcgccgactacattgctcagcgtcaaaac

SEQ ID NO: 836 - DNA, 957 bp, Picea abies
atgctaaggtgctccaacacaaacgcacaactggccaatctatccgagcaggtcaagggaaaggtaacggagttcgatttcaaggagtacatgcgatctaaagcaatgtccgtgaatgaagcactggacagagccgtccctctccgataccctgagaagattcatgaggctatgcgttactcgcttctggcgggcggaaagcgagtccggcccattctctgcattgcggcatgtgaactcgtgggcggatcagaggagctggccatgcctaccgcctgtgccatggagattattcataccatgagtctgatccacgatgaccttcccccaatggataatgatgacctacgtagaggtaaaccgaccaaccataaggtcttcggtgagggaacagcagtgctggccggtgacgctctcctctcgttcgccttcgaacacatcgccgtctcgacctctaaaactgtcgaatccgatcgcgttctgagagtggtgtcagagctgggccgagctacaggttctgagggggtcgcaggcggacaagttgctgatattacttcgcagggaaacccctcggtgggcctagagacgctggaatggattcacattcataagaccgctgttctcctggagtgttcggttgcatctggtgccattatcggtggagcctcggatgatgaaatcgagcgagttcgcaagtacgcccgatgcgtgggcttactctttcaggttgtcgatgatatcctagacgtcaccaagagctccgaagaactcggtaagaccgccgctaaggacctcctatccgataaggccacctacccaaagctcatggggttggagaaggccaaggagtttgccgatgagctgcttggcaaggccaaggaggaactgtccttctttaacccgacaaaggccgcccctctgctaggcctcgctgactacatcgctcaaagacagaat

SEQ ID NO: 837 - DNA, 1059 bp, Sus scrofa
atgaacggggatcagaagctcgacgcgtacgctcgagaacgacaggacttcattcaacacttctcacagatcgtgaaggtcctgaccgaggaggatattggccatcccgaaatcggcgacgctgtcgcccgcctgaaggaggtgctcgagtacaacgttgttggcggaaagtacaaccgaggcattacagtgctggttgtcttcagagagctggttgagcctcgaaagcaggacgccgattcccttcagcgggctctgaccgtcggctggtgcattgagctcctgcaggccttttttctcgtagctgacgacattgaggattcgtcgctgacacgccgtggccagacctgttggtacagaaagcccggaattggactcgacgccatcaatgacgcttttctcctggaagcttgtatttacagactgctgaagttttactgtcgagaacaaccctactaccttaacctcatcgaactgtttcttcagacctcctacaacaccgagattggacagactctagacttgatcgccggcccccagggcaacgtcgacttgtcgcgattcacagaaaaacgttacaagtccatcgtgaagtacggtaccgctttttacagtttttatcttccagtggccgccgccatgtacatggccggaattgatggagagaaggagcatgccaatgctaagaagattctcatggagatgggagaattcttccagattcaggatgactacctggacctgtttggggatccttcagtaacaggaaagatcggtacggatattcaggataataagtgctcttggctcgtggttcaatgtctgcagagagcctcccccgagcagcgacagattcttcaggagaattacggccagaaggacgccgaaaaggttgctcgagtaaaggccctatacgaagagatgaaccttcaggctgtgtttctgcagtacgaggaggactcgtacagtcacctcatgggtcttattgagcagtacgcagcaccccttcctcccgccatcttcctcgagctcgcacacaagatttacaagagacgaaag

SEQ ID NO: 838 - DNA, 1059 bp, Acyrthosiphon pisum
atgccggtcatcacgggcacagccgtttcgaaagatgagactcgtgacttcatggccgtgttcccggatgtcgtgcgagacctcacggataccgggcgtaatctggatgtccccgacgtgactaagtggttggccaagctgctacagtacaacgtccctggaggaaagaagaaccgaggtctggcgcttgtgctgtcgtacaagatgctttcttcccccgctgaccagacggatgagaacattcgactgtcgtatatcctgggctggtgtgtcgagatcctacaggcataccagctcgtgctggacgatatcatggacaacgccatcacaaggcgtggtagaccctgttggtaccgacacaacgacatcggcctcatggctgtgaacgacggcgttctgctcgagcagtctatctaccagcttatcaagaagtacttcaaggataagccgtattacacgcacatcctcgagctgttttacgatgtgacgatgaagacctccatgggtcaatgtctcgacatgctgaccgccaactcgttcaagtcgaaaaagctagagaagtataccatggagaactacacagcgatcgtcaagtatggaaccgcttactactccttttttttgcccgtgtgcttggccatgcgaatgaccaatattaatgaccctgagatcttcagacaggccaagaccattctgctggagatgggtcacttctttcaagttcaggatgacttcctcgactgctacggagaccccgacgtgatgggcaagattgggacggacattgaggatggcaaatgtagctggctagcggtggtagctcttcagaaggtgaattctgagcagaagaagattatggaggataactacggaattgacaaccccgctaacgtggctgtcatcaaagatttgtacgcccagctgaagctaccagacacctttcacctgtacgaggaggaatcatacaagctcatttgcacccatatccagcagctttctcgaggcctttctcaggatatgttcttcaagttcttggagaagatctacaagaggactctg

SEQ ID NO: 839 - DNA, 1077 bp, Mycobacterium tuberculosis
atgcggggaaccgacgagaagtacggtctccctccccagcctgactcggacagaatgacccgaaggaccctgcccgtgctgggattggcgcacgaactgattacccccactctgcgacagatggctgatcgactagaccctcacatgagacccgtggtgtcttaccatttgggctggtctgatgagcgagggcgtccagtcaacaacaactgcggtaaggcgatccgacccgccctggtgttcgtagcagccgaggccgccggagccgacccgcactctgctatccctggggccgtctcggttgagttagttcataacttctcgcttgtccacgacgatctcatggacagagacgagcaccgtcgacaccgaccaaccgtctgggcattgtggggggacgccatggccttgctggccggtgatgctatgctctccctggctcatgaggtgttactggactgcgactctcctcacgtgggagccgccctgagagcaatctccgaggccacacgcgagctgattcgtggccaagctgcagacactgcatttgagtcccgtaccgacgtcgccctcgacgagtgtctgaagatggctgagggaggtacagccgcgctgatggctgcatcggctgaggtgggagccctccttgccggagcccctcgaagcgtgcgcgaagcactggtcgcgtacgggcgtcatattggtttggcatttcagctagtcgatgaccttctgggaatttggggaagacccgaaatcaccggtaaacctgtttactctgaccttcgaagccgaaagaaaaccctgccggttacttggaccgtcgctcatggaggcttagccggtcgtcgactcgctgcctggctcgtggatgaaactggctctcagaccgcttctgatgacgaactcgctgcagtggccgaacttatcgaatgcggaggtggccgacgatgggctagcgccgaagctcgacgacatgttactcaaggcatcgatatggtggcccgaatcggaattccagaccgacccgccgccgagctgcaagacttggctcattacattgtggaccgacaagcg

SEQ ID NO: 840 - DNA, 879 bp, Staphylococcus aureus
atgacaaatctccccatgaacaagctcattgatgaggtgaacaacgaactgtctgtcgctatcaacaaatctgtgatggacacgcaactggaggaatccatgctctactcgctcaatgctggcggcaagcgaatccgacccgtgctcctgctgcttactttggacagtctcaacacagagtacgaactgggaatgaagtcggccatcgcactcgaaatgattcacacgtactctctgattcacgacgacctgcccgcaatggacaacgacgactatagacgagggaagctcaccaaccataaggtctacggagagtggaccgccattcttgccggagacgcgctgctcacaaaggccttcgaactgatctcttctgacgaccggctcaccgacgaggttaagattaaggtcctgcagcgattgagcattgcaagtggtcatgtgggaatggttggtggccagatgctcgacatgcaaagcgagggtcagcccatcgacctcgagacactggagatgatccacaagaccggtacgggtgcgctcctcacgttcgccgttatgagcgcagccgacattgcaaacgtggatgatactaccaaagagcacctggagtcgtactcttaccacctcggaatgatgttccagattaaggatgatctactggattgctacggcgacgaggcaaagcttggaaagaaagtgggttcggacctcgagaataacaaatctacgtacgtgtctctgcttggcaaggatggcgctgaggacaagctgacctaccatcgagacgctgctgttgacgagctgacccagatcgacgagcagttcaacaccaaacatctgctcgaaattgtcgatcttttttactcgcgagatcat

SEQ ID NO: 841 - DNA, 891 bp, Geobacillus sp.
atggctcaactttctgtggagcagttcctgaacgaacagaaacgcgccgtggaggccgcgctgtcttcctatatggcccgacttcgtgggcccgagactctcaagaaagccatggcatactctctggaggcaggaggaaagcggattagacccttgctgttacttgcaaccatccaagccctgggcaaggaccctgccatcggcctgcccgtggcttgtgccatagaaatgattcacacctatttcctaatacacgacgacttgccctgtatcgataacgacgacctacgccggggtaaacctacaaaccacaaagtttttggcgaggcgatggccatcctcgccggcgacgccctcctgacctatgctttccagttgatcgcagaggtagacgatgaccgcgtgcccccctcggttagactgcagctcattgagcagctggcaaaagctgcaggccctgagggcatggttgctggacaggccgccgacatggaggccgagggtaagacactggcgctggctgagttggaatatatacatcgacacaagaccggaaagatgctgcagtactccgtccacgctggcgcactgttgggaggagcggacggacgacaaactcgggaactcaacgagttcgccgctcatctcggactggcttttcaaatccgagatgacatcctggacatcgagggcatggaggagaagatcggcaaaagagtgggatccgaccgagacaacaagaaagccacataccccgtcctgctgtctctcggaggagccaaggaaaagcttgccttccacattgacgcagctaagcgtcacctgcagcaggccaagatcgatgatgccgtactggcctacatttgtgagctggtggcagttcgtgaccac

SEQ ID NO: 842 - DNA, 891 bp, Geobacillus sp.
atggctcagctgtcagtggaacagttccttaacgagcagaagcgtgcagtggaggctgctttatcttcttacatggcgcggctgcgtggccccgagacccttaagaaagcgatggcctacagtctggaggccggcggcaagcgaattcggcccttactgctcctggccaccatccaggccttgggaaaggaccctgcgatcggtctacctgtggcctgcgctattgaaatgatccacacctactcgctgattcatgacgacctgccttgcattgataacgacgacctgagacgagggaagcccaccaaccacaaggtgttcggcgaggctatggcaattctagcaggcgatgctcttctcacgtacgccttccagctgattgccgaagtcgacgacgaccgggtgcccccctccgtgcgcctgcagctgatcgagcagctcgccaaggccgcgggacctgagggcatggtcgcaggtcaggctgctgacatggaggctgagggcaagaccctcgccctcgccgaactggaatacattcatcgacataagaccggaaagatgcttcaatactcggttcacgctggtgccctcctgggaggagccgatggccggcagacccgagagcttaacgagtttgctgcacacttgggtcttgcttttcagattcgagacgatatcctggacattgagggcatggaggagaagattggtaaaagggtcgggtcggaccgcgacaacaagaaggcaacctaccccgtactcctctcgttgggtggcgccaaggagaagctcgccttccacatcgacgcagcgaagcgacacttgcaacaggctaagattgacgacgcagtccttgcttatatttgtgagctggttgctgtccgagaccat

SEQ ID NO: 843 - DNA, 891 bp, Geobacillus sp.
atggcccagctgagtgtggagcagtttctgaacgagcagaagcgagccgtggaggcagcattatcctcgtacatggcacgacttcgaggccccgaaacgcttaagaaggcgatggcctactccctggaggctgggggtaagagaatccgacccctgttactccttgctactatccaggctttagggaaggaccctgctatcggtctgcctgttgcgtgcgccattgagatgatccacacctactccttgattcacgatgacctgccgtcgatggacaacgacgacttccgaagaggtaagcctaccaatcacaaagtcttcggagaagccatggccatccttgcaggcgacgctcttctaacttatgccttccagctcatcgctgaggtggatgacgatcgagtccccccgtctgttcgtctgcagctgatcgagcagcttgctaaggccgccggacccgaaggcatggtggctggtcaagctgccgacatggaagccgaggggaagactttggcacttgccgagctggaatacatccaccgtcacaagaccggaaagatgctccaatactccgtccatgccggagctctcctgggtggcgccgatggtaggcagacacgggaactcaacgagttcgctgcccatctgggcctggctttccagatccgtgacgatatcctggacatcgaaggtatggaggagaagatcggtaaacgagtaggatcagatcgggataacaagaaggctacctaccccgttcttctttccttgggtggggccaaggaaaagctggcctttcatatcgatgcagctaagcgacatctccagcaggcgaaaatcgacgatgctgtactcgcttacatctgtgagcttgtggcggttcgagaccat

SEQ ID NO: 844 - DNA, 891 bp, Geobacillus sp.
atggcgcagctgtctgtcgaacaattcctgaacgagcaaaagcgagccgttgaggccgctctctcatcttacatggcccgactcagaggtccagagactctcaagaaggccatggcctactctctggaagctggaggcaagagaattcgaccgctattgcttctcgctacaatccaggccttgggcaaggatcccgccatcggcttgccggtggcttgcgcgatcgagatgattcacacctactcgttaatccacgacgacctgccttccatggataacgacgacctccgacgtggaaagcctaccaaccacaaggttttcggagaggccatggctattctcgcgggcgacgcattgttgacttacgccttccagctgattgccgaagttgatgatgacagagttcctcctagcgttcggctccagctgatcgagcagcttgccaaggctgcaggaccagaaggaatggttgctggacaagccgcggatatggaggctgaggggaagaccctagcattagccgagctggaatacatccaccgacacaagactggcaagatgttccagtacagcgttcacgctggcgccctcctgggcggagctgatggccgacagactcgcgagttgaacgagtttgctgcccatctggggctagccttccagattagggatgacattctggacattgagggcatggaggagaagattggtaagcgcgttggaagtgatagagataacaagaaagctacttacccagtcctgttgtctcttgggggggccaaggagaagcttgccttccacatcgatgccgccaagcgacacctgcagcaggccaagattgacgacgcagtgctcgcatatatctgcgaattggtcgccgtgcgagatcat

SEQ ID NO: 845 - DNA, 912 bp, Rhizobium acidisoli
atggacgccaaccgagacacatttgagactcgactcaaaaataacgcgcgggagattgaagccctgcttgacgctctgctgctcccaaacgcactctctgacgaaattgctagaccagaaactcttcgatctgctatgcattatgcagtccttaacggtggcaagcgccttcgtccctttctcgtcgtagagtcggccgcactgctcggaggtgacgacgaggccgctcgcagagtcggagctgccctcgaatgcgtacactgttactttctcgttcacgacgacttgccctgtattgatgacgatgacctgaggcgaggtaaacctaccgtgcatattaagttcgacgaggcgactgccatactcgccggcgactctctcctgacctacgcgtttgacatcattgcagcacccgagacggcgctggctgacacttcaaaggcttcccttgtgctcgccctcgcacgtgccgctgggctgggaggaatggccggcggtcaggctctcgaccttgccgccgaaaagcaggcacctgacgaagccggcatcattcggctccaagctatgaaaacaggcgcgctgattcgattcgcatgcgaagctggagccctaattgctgctagtcccccagaagaccgacggcgtttgcgtgcttttggagaaaaaattggtctggccttccagctcgctgacgacattctcgatcttacctccgatacggctactatgggcaaggcaacaggaaaagacgccgctaggggaaagggaacccttgttgcactccacggcatcgagtgggcagaggaacagctgcgacaacacgtgcgggacgccgaggcactacttgctccctacggcgctcgagcatccactcttattgccgcggcccatttcatcgctgaccggaagtcg

SEQ ID NO: 846 - DNA, 912 bp, Rhizobium acidisoli
atggacgccaaccgcgacacgttcgaaacacggttgaaaaacaacgcaagagagatcgaggcgcttcttgatgctctgttgctgcccaacgccctgtctgatgagattgcccgacctgagaccctgcggtccgccatgcattacgcagtgctgaacgggggtaagcgattgaggccgttcctggtggtggagtcggctgcccttctgggcggagatgatgaggccgctcggcgagtaggcgctgccctcgaatgcgtccactgctactccctagtgcatgatgacctgcccgctatggatgacgacgactttcgtcggggtaagcccaccgttcacattaagttcgacgaggccacagctatccttgcgggagacagtctcttgacttacgccttcgatatcatcgctgccccagagacggccttggccgacacctccaaggcctcgttggtcctcgccctcgctagggctgcaggtcttggtggcatggctggcggacaggcactggatctggctgctgagaagcaggcacctgatgaggctggcattatcagactccaggcgatgaagactggcgctttgatccgattcgcatgtgaggcgggtgccttgattgctgcatctcccccggaggaccgacggcgtcttcgtgcctttggtgagaagatcggcctcgcgttccagctggctgacgacattctcgacctgacatcagacactgccaccatggggaaggcaactggcaaggacgccgcacggggtaagggtacgctcgtcgccctgcatggcattgagtgggcagaggagcagctgcgtcagcacgttcgggatgctgaagcactactggccccttacggtgctcgggcctcaaccttgatcgccgctgcccactttattgctgacaggaagtct

SEQ ID NO: 847 - DNA, 912 bp, Rhizobium acidisoli
atggacgccaaccgagacactttcgagacgcgacttaaaaacaacgcccgtgagattgaggccctccttgatgcacttctactaccgaacgctctgagcgacgaaattgcccgaccggagactctcagatctgctatgcactacgctgttcttaacggcggcaagcgactacgcccgttcctcgttgtcgagtctgccgccctgctgggcggcgacgacgaggctgctcgaagagtcggcgcagccttggaatgcgtacactgttactccttggtccacgacgacctgccatgtattgacgacgacgacctccgacgaggcaagcctacagttcatattaagtttgatgaggcaaccgccattctggcaggagattccctcctgacctacgcctttgacatcatcgctgcccccgagacagctctggcagacacttctaaggctagcctcgtacttgctctcgctcgagcggccggtctcggcggaatggctggaggacaggctcttgatctggccgctgagaaacaggccccagatgaggctggaatcattcgactgcaggctatgaagacaggagccctgattcgatttgcctgtgaggccggtgcgctgatcgcggcttctccccccgaggaccgacgacgactgcgagcgttcggagagaagatcggccttgccttccagcttgcagatgacatcttggacctcacttcggacacagctaccatgggcaaggctactggcaaggacgctgcccgaggaaaaggaaccctagtcgccctccacggcattgagtgggccgaggagcaactccggcagcatgtgcgagatgctgaggctctgctggcaccctacggagctagagcctcaaccctgattgcagctgcccacttcattgccgacagaaaatct

SEQ ID NO: 848 - DNA, 897 bp, Escherichia coli
atggactttccccaacagttggaggcttgcgtgaagcaggctaaccaagctctctcccgattcatcgctccactgccgttccagaatacgcctgtcgtagagacaatgcagtacggtgccctgctgggtggcaagcgactacgcccgtttctagtatacgcaaccggacacatgtttggagtctccactaacactctggacgccccagccgcggccgtagagtgcatccacgcctacttcctcattcatgatgatctcccctgtatcgacgacgatgatcttaggcgaggtctaccaacgtgtcacgtcaagttcggtgaggctaacgctatcctggccggagacgcccttcagacactggctttctctatcctgtctgacgcggacatgccagaggtatctgaccgagatcgcatctcgatgatttcggagctggcctcagctagcggcattgctggtatgtgcggaggtcaggcactggacctggacgccgagggcaagcatgtgcctctggatgccctggagcgcattcaccgacataagactggcgcgctcattcgggccgctgtacgactgggcgctctttctgccggggacaagggtcgacgagccttgcccgtgcttgataagtacgcggaatcgatcggcttggcctttcaggttcaggatgacatcctcgacgtcgtcggtgacaccgccactctgggaaagcggcagggagccgatcagcagctgggcaagtctacttaccctgccctgctcggactcgagcaggcacgaaagaaggcacgagacctgattgacgacgctcgacaatccctgaagcagctcgctgagcagtccctggatacttctgcgctagaggccctcgctgactacattattcagagaaacaag

SEQ ID NO: 849 - DNA, 897 bp, Escherichia coli
atggatttcccccagcagctggaggcttgcgtgaagcaggctaaccaggcgctgagtcgattcatcgcccccctgccctttcagaacacccccgtcgtcgagactatgcagtatggtgcgctgctgggaggcaagcgcttgagaccgttccttgtctacgccactggtcatatgttcggagtatccaccaataccctcgacgctcccgccgctgctgtcgagtgcattcatgcatactctctgatccacgatgatctacccgctatggacgatgacgacttccgacgtggattacctacctgccatgtgaagtttggcgaggctaacgcaattcttgctggagacgccctccagacacttgccttctcgattctctctgatgctgatatgcccgaggtgtccgacagagaccgcatttctatgatttccgaattggcatcggccagtggcatcgctggtatgtgtggcggccaggccctggatctcgacgcggagggtaagcacgtcccgctggatgctttggagcgcatccatcgacacaagaccggggccctaattcgtgctgctgtgagactcggtgctctcagtgccggtgacaagggtcgccgagctcttccagtcttggacaaatacgccgagagtattggactcgcttttcaggtgcaggacgatattcttgacgtggtcggcgacaccgccacgctgggaaagcgacagggcgctgaccagcagctaggtaagagcacttaccccgctctcctcggtctcgagcaagctcgtaagaaggccagggacctcatcgacgacgccaggcagtccctgaagcagttagctgagcaatcacttgatacgtccgccctcgaagccctggctgactacatcatccagcgcaacaag

SEQ ID NO: 850 - DNA, 897 bp, Escherichia coli
atggattttccccagcagctcgaggcttgcgtcaagcaggcaaaccaagcgctctctagatttatagcgcccctcccattccagaatacacccgttgtggagacaatgcaatacggtgcccttctaggtggtaagcgacttcgaccatttctcgtgtacgctaccggacatatgtttggtgtatcaaccaacacccttgacgcccccgcagcggccgtcgagtgcatccatgcgtatagccttattcacgacgaccttccttgcattgacgacgacgaccttcgacgaggcctgccgacgtgccacgtgaagttcggcgaagcgaacgctatcctagccggagatgctctgcagacgttggcattctcgatcttgtctgatgccgacatgcccgaggtttctgatcgggaccgtatctcgatgatctccgagcttgccagcgctagcggaattgcaggaatgtgcggagggcaggccctggatctggacgctgaaggaaagcacgtgccccttgacgctctagagcgaattcaccgacataagacaggggctctgatccgtgccgccgtccggctgggcgccctgtccgctggagacaaaggccgacgtgccctgccagttctggacaagtatgctgagagcattggcctagcctttcaagtgcaggacgacattctggacgtcgtgggagacactgctaccctgggaaagcgtcagggagcagaccagcagctgggtaagtcaacctaccccgccctcctgggactcgagcaggcgcgtaagaaggctcgggatttgatcgatgatgcccgccagtccttaaaacagttggcagagcagtccctagatacatctgctctcgaggcacttgccgactacataattcagcgtaacaaa

SEQ ID NO: 851 - DNA, 912 bp, Brucella suis
atggaaaagttgcctgtggatttcaccacgctcctgaaccgacgggctatggaagttgaagcggctttggccggactcttggacgaatgtccccgcactggggaaattgcacgacctcagcgactcattgctgcgatgcgacatggtgtcctcaatggcggcaagcgcctgaggccctttttggtccttgaatctgccgccttgttcggccagtacggacaggcagtgctgcgtgtggcggccgccttggagtgcatccactgctacttcctggtgcacgacgatctgccttgcattgacgatgacgacttgcgacgaggacaacccacggtgcacaaggctttcgatgaggccgccgcaattcttgccggggatagtctgcttacctacgcgttcgacatcatcgcctctgacgagaccgagctggacgccacaacccggatcaagctcgtctgtgccttgactcgggcgagcggactcggaggaatggccggcggacaagcccttgacctgatggccgagacccgaaagcctgacgaggccggcatcattaccctgcaggccatgaagacgggcgccctgatccgtttcgcgtgtgaggcaggcgccattatcgcgggagcctctcaggaagacagagagagaatggccgagttcggcagtgcaatcggcctggcattccagctggcggatgaccttctggatgttacagccgacgcgggtacaatgggtaaggccaccggcaaggacgccgctgctggaaaggcgaccctcgtctcccttcacggtatcgactggacccgacagcaactcagtggactggtggcccaggccgagagtctgctggctccttttggagaagacgctgagcctctcaagcaagcagctcgatttatcgcagagagacagaac

SEQ ID NO: 852 - DNA, 912 bp, Brucella suis
atggagaagctccctgtcgacttcacaaccttgctgaaccggcgcgccatggaggtcgaagccgcgctagccggtcttctcgacgagtgcccccgaacgggtgagattgccagaccccaacgactgatcgcagccatgcgacatggagtgctcaacggaggtaaaaggctccgaccctttctcgttctcgagtccgccgccctgttcggtcagtacggacaggccgttctgcgcgtcgccgctgcgctggagtgcatacactgttactctctcgttcatgacgacctgccttgtattgacgatgatgacctgagacgcggtcagcctaccgttcataaggcgtttgacgaggctgcagccattcttgccggcgattctcttctcacttacgctttcgacatcattgcctcggacgagactgaactcgacgcaaccacccgaattaagcttgtgtgcgccctcacccgagcctcagggctgggtggtatggcgggaggccaggcccttgacctcatggccgagactcggaagcccgatgaagccggaattattactctccaggcaatgaagaccggcgcactgattcgatttgcatgcgaggcaggcgcaattattgcgggagcctcccaggaggatcgggagcgaatggccgaattcggatcggctatcggcctggctttccaactggcagacgacttgctcgacgttaccgccgacgccggcacaatgggtaaggcgactggtaaagacgcggcagcaggaaaggccacgcttgtgagtctgcacggcatcgactggactcgacagcaactgtctggactggtcgcccaggctgagtcgctgctggccccattcggagaggacgcagagcctctgaagcaggccgcgaggttcattgccgagcgacagaac

SEQ ID NO: 853 - DNA, 846 bp, Buchnera aphidicola
atgcatttttttcacctttacgaacgatataagcatcgaatcaaccagaagctcttctacactctgaatcagctacctttccagaaatcgtccctcctgaaggccatgaagtactcggtcttctcgggctccaaacgactgagaagctctttgatttattctacgggagatgtgttcaaggtcaacatcaccacgttggatgtgatcagcactgcaatcgagtttatccattcgtactttctgatccatgatgaccttccctgcatagacaatgacaacttcagaaggggaaaaatctcgtgccacgtcaagtacggagaatccacctcactccttgctggagatgcactgcaatcactggccttcaatatcctctctaactcctttatgcctaatgtctcaaacctaaagcggatcaagatgattagtgagctgtcttattcgattggatccagtggcatgtgtatgggacaaaatctggaccttgaggcagagaagaaggatgttaacctatccgagctcgagatcatcaacctctacaagacatcctttctcatgagatctgctgtgcgtctcgtttatttttcttcaaacaatttctctaagtctatccttagcattctggacctgttttccattagtatcggactggcttttcagattcaagatgacattctggacttcaagaaggattccgtcaagactgacaacaagaagattattaagaagcacacctaccccctcatcattggtctggacgagtcacgaaaaaaaattaagcagctccacaagaaaagctttctcgccctcaactccttgaagaagaagatttctatcccaacctat

SEQ ID NO: 854 - DNA, 846 bp, Buchnera aphidicola; identical to SEQ ID NO: 853

SEQ ID NO: 855 - DNA, 846 bp, Buchnera aphidicola
atgcacttcttccacctctatgaacgatacaaacatcgaattaaccagaagctgttctatactctgaaccagttgccctttcagaaatcctctctgttgaaggccatgaaatacagtgtgtttagcggatcaaaacgactgaggtcttcgttgatttacagcactggcgacgtcttcaaggtcaacattaccaccctggatgtgatttctaccgccatcgaatttattcactcttattcactgattcacgatgatctgccctgtatggacaacgacaactttcgacgtggtaagatctcatgccatgttaagtacggcgagagtacctcgctccttgcaggcgacgcattgcaatcccttgcctttaacattctctctaattcattcatgcctaatgtttccaacctcaagcgaattaagatgatctccgagttgagctactctacggggtcctcgggtatgtgcatgggccagaacttggacttggaggccgagaagaaggatgttaacctctctgaactggagattatcaacctctacaagacgtccttccttatgcgctcggccgttagattggtttatttctcatctaacaactttagtaaatccatcctgtccattctggatctcttctcgattagcattggactggcctttcagatccaagacgacattctcgactttaagaaagactcggttaaaaccgataacaagaagatcattaagaagcacacctacccccttattatcggactggacgagtcgagaaaaaaaattaagcaactgcacaagaagtcctttctagctcttaactccctcaagaaaaagatttccattcccacttac

SEQ ID NO: 856 - DNA, 1065 bp, Dendroctonus ponderosae
atgattcgaccggtgcaaagctctgctctcgttacgaaagagcagtctcgggacttcatggctctgtttcccgaccttgtcagagagctgaccgaggtgggtaagtcgcaagagctgcccgatgtgatgcgacgattcgcccgcgtcttgcagtacaacacccccaccggaaagaagaatcgaggtctgattgtcctgtctacctaccggatgctggaggaccctgaaaaactgacccccgagaacatccggcttgcgtccatcctgggatggtgtgtggagatggttcacgcctactggctcatcctcgatgatatcatggatggctcagaaacccgacgaggtgccctctgttggtttcgacaatccggtattggactcacagccgtttgggatgcagtcatgatcgaaaacgctgtctacctcctgattaagcgtcacctcaaggaccaccccatgtacgtgcctctgatggagctctttcacgagggtaacctaaagaccacgcttggacagtccctggatgccatgtgcctggatacaaacggtaagcccaagcttgacatgtttacaatgtctcgatacaccagcattgtgaagtacaagacagcgttctattccttccagatgcccgtggccatcgccatgtacctggccggaatgtccgatgaagagcagcaccgacaggccaagactattctcatggagatgggccagtttttccagatccaggacgacttcctcgactgttttggcgaccctaccgttaccgggaaggtcggcactgacatccaggacggcaagtgttcgtggctggccgttgttgccctgcagagagcttcgccggcccaacgcaaaattatggaagagcattacggtcgacctgagcctgagtcgattgctagaatcaagaatttgtacgtggacctttgcctgcctaacacatacgccatttacgaggaggagagctttaacataatcaaaacccacattcagcagatttcgaagggtcttcgacatgacctcttcttcaagatcatggagaagatttacaagcgggagtgc

SEQ ID NO: 857 - DNA, 942 bp, Picea abies
atgaaagccttggtgcagttggccgacctgtctgagcaggtgaagaacgtggtcgagtttgactttgataagtacatgcattctaaggcgatcgccgttaacgaggcacttgacaaggtgatcccccccagatatcctcagaaaatctatgagtctatgcggtattccctgcttgccggaggtaaacgtgttcgacccatcctctgtattgctgcctgcgagctcatgggaggaactgaagagctagccatgcccaccgcctgtgccatcgagatgatccatacgatttcactgatccacgatgacctcccttacatcgataacgacgatctacgacgggggaagcctaccaaccataaagtctttggggaggatacggccatcatcgctggcgatgcgctgctttccctggctttcgaacatgtcgccgtgtccacgagccggacacttggaactgacatcatcctgagattgctatcggaaattggacgtgcgacgggctcagaaggcgtgatgggaggtcaggtggttgatatcgagtcagagggtgatccctcgatcgatctggagacgctggagtgggtgcacatccacaagacagcagtgcttctcgagtgttccgttgtgtgtggagccatcatgggcggtgcatccgaggacgacattgagcgagctcgacggtacgcccgatgcgtcggcctgctgtttcaggttgttgatgatattctcgacgtttctcagtcttccgaggagcttggaaagaccgcaggcaaagacttaatctccgacaaggctacctatcccaagctcatgggactcgagaaggccaaggagttcgccgacgaactcctgaacagaggaaagcaggagctctcgtgctttgaccccaccaaggctgcgcctctattcgccctcgccgattacattgctagtcgtcagaac

SEQ ID NO: 858 - DNA, 942 bp, Picea abies
atgaaggccctggtccagttggctgatctgagcgagcaggtgaaaaatgtggttgagttcgattttgacaaatacatgcactccaaggccatcgccgtcaacgaagccctggataaggttatcccaccccgatacccccagaagatctatgaatcgatgcggtacagtctcctcgctggaggtaagcgagtccgtcccattctgtgcattgcggcctgcgagctgatgggcggtaccgaagaactcgcaatgcctaccgcctgcgctatcgagatgattcatacaatgtccctgattcacgatgaccttccgtatatagacaacgatgattttcgacgaggtaagccaacaaatcacaaggtgtttggagaagacaccgccatcatcgcaggagacgctctgctctctctggctttcgaacatgtggccgtgtctacttcacggacccttggcactgacattattctgaggctgctgtcagagattggtcgggctaccgggtctgagggcgttatgggcggccaggtcgtggatattgaatcagagggcgatccgtccattgacttggagaccctggaatgggtccatattcataagactgcagtacttcttgaatgctcggtggtctgcggtgcaatcatggggggcgcgagcgaggatgacatcgagcgggcccgtagatacgcccgatgcgttggattgctcttccaagttgtggacgatattctcgacgtctcccagtcctctgaagagctgggtaagaccgccggcaaggacctgatctccgacaaggccacctaccccaagctgatgggactggagaaagctaaggaattcgcagatgaactgctcaaccgaggtaagcaagagctcagctgctttgaccccacaaaggctgcccctctttttgcactcgctgactatattgccagccggcagaac

SEQ ID NO: 859 - DNA, 942 bp, Picea abies
atgaaggccctggtccagctcgcggacctgtcggagcaggtgaaaaacgtggtggagttcgatttcgacaagtacatgcactcgaaggccattgctgtgaacgaggctttggataaagtgattccgccccgatacccacagaagatctacgagagcatgcgatactctctgctggcaggtggtaagcgagtgcggcctatcctgtgtattgcagcctgcgagttgatgggcggcaccgaagagctggctatgcctacagcttgcgccatcgaaatgatccacaccatgtcacttattcatgatgatctaccttacatcgacaacgatgatctgcgacgtggtaagcccacaaaccataaggtcttcggagaggacactgcgatcattgccggcgacgcccttctgtctctggcctttgagcacgttgccgtgtctacgtccagaaccctgggtactgatattattttgcgactcctgtcagagattggtcgagccacaggctctgagggcgttatgggcggacaagtagtagacatcgaatctgagggtgatccatcaattgatctggagaccctagaatgggtgcacatccataagactgccgtgctttttgagtgttcggttgtgtgtggcgcaattatggggggagcttctgaggatgatatcgagcgcgcccgacggtatgcccgatgtgtcggccttctcttccaggtcgttgacgacattcttgacgtgtctcagagctccgaagagctcggaaagaccgctggtaaggatctgatctccgacaaggccacctaccctaagctgatgggtcttgagaaggctaaggagttcgctgatgagctgttgaaccgaggcaagcaggagttgtcttgctttgaccccaccaaggccgctcccctttttgccctggcagactacatcgcctctaggcagaac

SEQ ID NO: 860 - DNA, 900 bp, Abies grandis
atgaaggctgtggagttcgacttcaacaagtatatggactcaaaggcgatgaccgtgaatgaggccctcaacaaagccatcccactgagatatccgcagaaaatctacgagtctatgagatactccttgctagcaggcggcaagcgtgtccgtcccgtgctctgcattgctgcttgcgagttggtgggagggactgaggaactggccattcccaccgcctgcgcgatcgagatgatccatactatctcgctgatgcacgacgatctaccatgcatcgacaacgacgacttaagacgaggcaagccgacaaaccacaagattttcggcgaggacaccgccgttactgccggaaatgcccttcactcatacgcctttgagcacattgccgtttcgacatctaagaccgtgggcgcggatcgaatcctgagaatggtgtctgagctcggtcgagcaactgggtcggagggtgtcatgggcggacagatggtcgacattgcttctgagggtgaccctagcattgatcttcagactttggagtggatccatattcacaagacggccatgcttctggagtgcagcgtcgtctgtggcgccattattgggggcgcttctgagatcgtgattgagcgagcccgacggtacgcacgatgcgtcggactgctcttccaggtcgttgatgacatcctggacgtgaccaaatcttcggacgagctgggaaagactgccggaaaggatctcattagcgacaaagcgacctaccccaagctgatgggcctcgagaaagctaaggaattttcagacgaacttctcaaccgagcaaagggtgaactgtcctgtttcgaccctgtgaaagccgcccctctcctgggcctggcggactacgttgcatttcgacaaaac

SEQ ID NO: 861 - DNA, 900 bp, Abies grandis
atgaaagctgtggagtttgatttcaacaagtacatggactccaaggcaatgaccgttaatgaagccctgaacaaggccattcccctgcgatacccccagaaaatttacgagtcaatgcggtactcgctcttagcgggaggaaaacgcgtgcgccctgtgttatgcatcgccgcatgtgagcttgttggaggaactgaagagctagccattcctaccgcgtgcgctatcgaaatgatccatactatgtcgctgatgcatgatgacttgccctgtattgacaacgacgactttcgacgaggaaagcccactaaccataagatcttcggcgaggacaccgccgtcactgccggaaacgctctgcactcctacgctttcgagcacatcgctgtctccacaagtaagaccgtgggagcagaccgcattcttcggatggtgagcgaactcggccgagctactggttctgagggcgtgatgggtggacagatggtagacatcgcgtccgagggagacccctctattgatctgcagactttggaatggatccatatccacaagactgctatgctgcttgagtgttcagtcgtgtgtggcgctatcattggaggcgctagcgagattgtgatcgaaagagccagacgttacgcccgatgcgtgggccttttgtttcaggtggtcgatgacatccttgacgttactaaatcttctgacgaactgggaaagaccgctggtaaggacctgatatctgacaaggctacctaccccaaactgatgggtctggagaaggccaaagagttctccgacgaattgttgaaccgggctaagggcgagctttcctgcttcgacccggttaaggccgctccccttcttggccttgcggattacgtggctttccgccaaaac

SEQ ID NO: 862 - DNA, 900 bp, Abies grandis
atgaaggctgtcgaatttgacttcaacaagtacatggatagcaaagctatgaccgtgaacgaggccttgaataaggctattcccttgcgatatccgcaaaagatttatgagtctatgcgatactctctgctcgctgggggaaaacgagtccggcctgtgctgtgtatcgcagcctgtgagttggtcggaggtaccgaagagttggctatacccaccgcttgtgcgattgaaatgatccacactatgtcgctgatgcatgacgacctgccatgcatcgataacgatgacctgcgaagaggaaagcccaccaaccacaagatattcggggaggatactgcagttacggcaggtaacgccctgcattcctacgccttcgagcatatcgcagtttcaacttccaagaccgttggcgccgaccgaattctccgaatggtctctgagctcggacgagctacaggatcagaaggagttatgggcgggcagatggttgacatcgcatctgaaggcgacccctcaattgacctccagactcttgagtggatccatatccataagaccgcgatgttatttgagtgttccgtggtctgtggcgccatcatcggcggtgcctcggagatcgtcatcgaacgagcccggcgatatgcgagatgcgtgggcctgctctttcaagtggttgacgacatcctggacgtcaccaagtcttctgacgagctcggcaaaaccgcaggaaaggacctgatctcggacaaggccacttaccccaagctgatgggacttgagaaggcaaaggagttctccgatgagctgctcaaccgagccaagggtgaactctcgtgctttgaccctgttaaggccgcgcctctgctaggcctggcagattatgtagcgtttagacagaat

SEQ ID NO: 863 - DNA, 957 bp, Picea abies
atgctccgatgctctaacaccaacgcccagctcgcaaacctgtccgaacaggtaaagggcaaggttaccgagtttgatttcaaggagtacatgcgaagtaaggctatgtctgtcaacgaggctttagacagagcagtgccgcttcgataccccgagaagattcacgaggccatgcgatactccctcttggctggaggcaagagagtgcgacccattctgtgtatcgccgcatgcgagcttgtcggtggttctgaagagttggccatgcccaccgcatgtgccatggaaatcattcacaccatgttcctcattcacgacgacctcccttgtatcgacaacgacgacctgcgacgtggcaagcccacaaaccacaaggtgttcggagagggaaccgccgtcctggccggtgacgccctcctgagttttgcctttgaacatattgccgtctcgacctctaagactgttgagagtgaccgggtgctgcgcgttgtctctgagcttggccgagcaattggtagcgagggcgtggcgggaggccaggtagccgacattacctcccaaggcaacccatctgtcggactcgagacgctcgagtggatccacatccacaagactgccgtattacttgagtgttcggtggcaagcggcgctataatcggaggagcttctgacgacgagatcgagcgagtgcgaaaatacgctcggtgtgtaggcctcctgtttcaggtagtggacgacattctggacgttacaaagtctagtgaggagctcggcaagacggccgcaaaagacttgctgtctgacaaagccacctaccccaaactcatgggactggaaaaagccaaggagttcgcagatgagcttctgggtaaggctaaggaggagctgtcttttttcaacccgactaaggccgctcctctgctgggactggctgactacatcgcccagagacagaac

SEQ ID NO: 864 - DNA, 957 bp, Picea abies
atgctccggtgtagtaatacgaacgctcagctggccaacctgtcagagcaggtgaagggaaaggttactgagtttgacttcaaggagtacatgcgctctaaggccatgtccgtcaacgaggcactcgaccgcgctgtcccacttcgatacccagagaagatccacgaggcaatgcggtatagtcttctcgcaggcggaaagagggtgcgacccatcctctgtatcgccgcatgcgagcttgtcggagggtctgaggagctggccatgcccaccgcttgcgcgatggagatcatccacaccatgagcctcatccatgatgaccttccatgtattgataatgatgatctgcggcgtggtaagcccaccaaccacaaggtgtttggtgagggcacagccgtccttgccggagatgcactgctttcttttgcttttgagcacatcgctgtctcgacctctaagactgtggagtcggaccgcgtccttcgtgttgtatctgagcttggccgagctatcggctccgagggcgtggccgggggtcaggtggccgatattacaagccagggcaaccctagcgtgggtttggagaccctagagtggatccacattcataagaccgccgttctgctcgagtgctctgttgcctctggggccattatcggtggcgcctctgacgacgagatcgaacgggtaagaaagtatgctagatgtgtaggtttgttgttccaggttgtggatgacatcctggacgttactaagtcatctgaagaattgggtaaaacagccgctaaggaccttctctctgacaaggctacgtatccaaaactgatgggcctcgagaaagccaaggagtttgctgatgagcttttgggcaaggcaaaggaggagctgtcgttcttcaaccccaccaaggccgcccctctattgggactcgctgactatatcgcccagaggcagaac

SEQ ID NO: 865 - DNA, 957 bp, Picea abies
atgctgcgatgctcaaacacgaacgcccaactggctaacctgtccgagcaggtaaagggcaaggtcactgaatttgacttcaaagagtacatgcgatccaaggctatgtccgttaacgaggctctcgatcgagctgtccctctccgttacccagaaaaaatacatgaggccatgcgatactccctgctggccggcgggaagagagttcgacccattctgtgcatcgccgcttgcgagctcgtgggaggctctgaggagctcgctatgccgaccgcctgcgccatggaaattatccacaccatgtcactgatccatgacgatctgccccctatggacaatgacgacttccgacggggtaagcccacaaaccataaagtctttggcgaaggtactgctgtgctggcaggtgacgctctgttgtccttcgccttcgagcacatcgccgtgtcaacttccaagaccgtggagagcgatcgtgttcttcgcgtcgtttctgagcttggccgagcgatcggttcggaaggcgttgctggtggacaggtggctgatataacctctcagggcaatccctcggtcggacttgagacactcgagtggattcacatacataagactgccgtcctcctggaatgttccgtcgcctccggagccatcattggcggcgctagtgatgatgaaatagagcgggtcagaaaatatgcacgatgtgtcggactgctttttcaggtcgtcgacgacattctggacgtgaccaaaagctccgaggaactcggcaaaactgccgcgaaggacctgctgtctgataaggcaacctacccaaagctcatgggactggaaaaggccaaggagttcgcggacgagctcttgggaaaggccaaggaagagctaagcttcttcaaccccactaaggctgctccactcctgggcctcgctgattatatcgcccaacgacagaac

SEQ ID NO: 866 - DNA, 1059 bp, Sus scrofa
atgaacggagaccagaagctggatgcctacgccagggagcggcaggactttattcagcatttttcccaaatcgttaaggttctcacagaggaagacattggacatccggagattggtgatgccgtggctcgcctcaaagaggtgcttgaatataacgtcgtcggtggaaagtataatcggggaattactgtgctggtcgtattccgggagctggtcgagcctcgaaagcaggatgcagactccctgcagagagctttgaccgttggctggtgcatagagctgctgcaggccttttggcttgtggctgacgacattgaagattcctcccttacgcggcgcgggcagacctgttggtaccgaaagcccggcattggcttggacgcaatttgggacgctttcctcctggaagcctgcatctaccgtctcctgaagttctactgccgagagcaaccttattacctcaacttaatcgagctgttccttcagacttcttataacactgagatcggacagacactcgatttgatcgccggaccccaagggaacgttgacttatcgcgattcactgagaagcgatataagtccattgtcaagtacaagaccgccttttactcgttttacctcccggtggccgcagccatgtacatggccggtatagatggcgagaaggagcatgcgaacgccaagaagatcctgatggaaatgggcgaattcttccaaatccaagacgattacctcgaccttttcggcgaccctagtgttaccggtaagattggaaccgacatccaagacaacaagtgcagctggctagttgtccagtgtctccagcgagcctcgcctgaacagcgacagattctgcaagaaaattacggacagaaggacgctgagaaggttgctcgtgtgaaggctctatacgaggaaatgaacctgcaggccgtttttctccagtatgaggaggattcctactctcacttgatgggtctaatcgagcagtacgcagcaccgttgccccctgcgatcttcctggaacttgctcacaagatttataagcgacgaaag

SEQ ID NO: 867 - DNA, 879 bp, Staphylococcus aureus
atgaccaacctcccaatgaataagttgattgacgaggtcaataacgagctttcagtcgctattaacaagtcggtaatggacacccaactggaggagtccatgctgtactcactgaacgccgggggtaagcgaattaggcctgtcctactcctgctgacgttagactcactcaatacagagtacgagttgggcatgaagtcagcgatcgctctcgagatgatccatacctactttctgattcacgacgatctcccctgtatcgacaacgacgactaccgtcgaggaaagctcaccaaccataaggtgtacggcgagtggacagccattctcgcaggcgacgcgctgctcaccaaggctttcgagctgatttcctctgatgaccggctcactgacgaggtgaagattaaggtcttgcaacgactaagtatagcctcgggacacgttggcatggtggggggacagatgttggacatgcagtctgagggacagcctattgatctggagaccctggagatgatccataagaccaaaaccggcgccctactcaccttcgcagttatgtccgctgccgacatcgcgaacgtggatgacacaactaaggagcacctggagagctacagttatcacctcggaatgatgttccagatcaaggacgatctgctggactgttacggagatgaagccaagcttggcaagaaggtcgggtcggacctggagaacaacaagtctacttatgttagcctgctcggtaaggatggagccgaagacaagttgacataccatcgagatgctgccgtcgacgagttgacccaaattgatgagcagtttaacaccaagcacctacttgaaattgtggatctgttctactcccgagaccac

SEQ ID NO: 868 - DNA, 879 bp, Staphylococcus aureus
atgaccaacctaccgatgaataagcttattgacgaggtgaataatgagctgtccgtcgccatcaacaagagcgtcatggacacccagctcgaagagtctatgctgtattctcttaacgctggtggtaaacgaattcgacccgtgctgctgctcctcaccctggacagcctgaacaccgagtacgagttgggaatgaagagtgccattgccctggagatgattcacacctactctctcattcatgacgacctgcccgcgatggataacgatgactatcggcggggaaaactgaccaaccacaaagtatacggcgagtggacggcgattctcgcgggtgatgccttgctcaccaaggccttcgagctcatctcgtctgacgaccggcttaccgacgaagttaagatcaaggtgctgcagcggctgtcgatagcttccggtcacgtgggaatggtaggaggccagatgctcgacatgcagtctgaaggacagcctatcgatttggagacgctggaaatgatccataagacaaaaaccggagcactgtttacctttgccgttatgtccgccgctgacattgcgaatgtggacgacaccacgaaggagcatttggaatcttatagctatcacctcggaatgatgtttcagattaaggacgacctgctggactgttacggagacgaggctaagcttggcaaaaaggtcggttccgacttggagaataacaaatccacctacgtttcgctgctgggcaaggatggggctgaggacaagcttacctaccacagagacgcagccgtggatgagctgacccagattgacgagcagtttaacaccaaacatctgctggagatcgtggacctcttctactctcgagatcat

SEQ ID NO: 869 - DNA, 879 bp, Staphylococcus aureus
atgactaacttgcctatgaacaagctcattgacgaagtcaacaacgagctgtccgttgccatcaacaagagcgtgatggacacacagctggaggagtctatgctgtattctttgaacgccggtggcaagcggattcgtcccgtgctcctcctccttactctggatagcctgaacacagaatacgaactgggcatgaagtcagccatcgccttggagatgatccatacatactcgctgattcatgatgatctcccgtgtattgacaacgatgactatcgtcggggcaagttaactaaccacaaggtctatggtgaatggacggcaattctggcaggtgacgctctactaaccaaggcctttgagctcattagcagcgacgacaggttgacggacgaggtcaagatcaaggtgctgcagagactctctattgcttctggacacgtcggcatggtgggcggccaaatgctcgacatgcagtctgaaggacagcccattgacttggaaaccctcgaaatgatccataaaaccaagacgggtgccttgctgactttcgccgtcatgtcggccgccgacatcgctaacgtcgacgataccacaaaggagcacctggagtcttactcttatcaccttggaatgatgttccagatcaaggatgatctgctggattgctacggagatgaggcgaagcttggaaagaaagtcggttctgatcttgagaacaacaagtccacctacgtgagcctgcttggcaaggacggcgccgaggataagttgacctaccatagggacgccgctgtggacgaattgacgcaaatcgacgagcagttcaacacaaagcaccttctcgagatcgttgatttgttctattccagagaccat

SEQ ID NO: 870 - DNA, 891 bp, Geobacillus sp.
atggcacaactctcagtcgagcagttcctgaacgagcagaaaagagctgtggaggccgctctctccagctacatggcccgactgcgaggccctgaaactcttaagaaggccatggcctatagcctggaggctggtggaaagcgtatcagacccctgctcctcctggctacaattcaggctctgggtaaggaccctgccatcggactacccgtggcctgtgcaatcgagatgattcacacctatttccttatccatgacgaccttccttcgatggacaacgacgacctgcgccgaggaaagccaaccaaccataaggttttcggtgaggctatggccattctggctggagacgcgctgctgacctatgcctttcagctcattgcagaggtggacgacgacagagtgcctccgtccgttcgactacagctgatcgaacaactcgccaaagctgccggacccgaaggaatggtcgctggacaggcggccgacatggaggccgagggcaagaccctggctcttgccgaactcgagtacattcacagacacaagactggaaaaatgcttcaatattccgttcacgctggcgctctgttgggcggcgccgatggaagacagacacgagagctcaacgagtttgcagctcatctaggcctagcattccagattcgagatgacattctcgatattgagggaatggaggagaagatcggtaagagagtaggtagcgaccgtgataataagaaggccacctatcccgtgctactgtccctaggtggcgccaaggaaaagctggcctttcatatcgacgctgctaaacgacatcttcagcaggcgaagatagacgatgccgttctggcgtacatttgcgaactggtggccgtccgagaccat

SEQ ID NO: 871 - DNA, 1062 bp, Saccharomyces cerevisiae
atggcgtcggagaaggaaatacgccgagagcgcttcttgaacgtgttccctaagctcgtggaagagctcaacgcctcgctcctggcctacggtatgcctaaggaagcgtgtgattggtacgcccattctctcaactacaacactcctggagggaagctcaaccgcggattgtcggtcgtcgacacctacgctattctctccaacaagaccgttgagcagttgggccaggaagagtacgaaaaagtggccatccttggatggtgtatcgagctgctccaggcttacttcctggttgccgatgacatgccgtgtatcgataagtcaatcacaagaagaggacagccctgctggtacaaggtgcccgaggtcggtgaaattgcgatcaatgatgcgttcatgctggaggctgctatctacaagctgctgaagtcccattttcgaaacgaaaagtactacatcgacatcacagagctgttccatgaagtcacattccagacagaactgggacagctgatggacctcatcacagcgcccgaggataaggtggacctatcaaagttttcactcaagaagcactccttcattgtgaccttcaagacggcctattacagcttctacctgcccgtggctctggccatgtacgttgccggtatcactgacgagaaggatctgaagcaggcccgagatgttctcatccccctgggcgaatactttcagatccaggacgactatctggactgctttggcacaccagagcagattggcaagatcggtactgatattcaggacaacaagtgttcgtgggtcattaacaaggcactcgagctggcttcagcggagcagcggaagacactggacgagaactacggcaagaaggattcagttgccgaggcaaagtgtaaaaaaatctttaacgacctgaagattgagcagctataccatgagtacgaggagtctatcgctaaggatcttaaggctaagatttctcaagtcgatgaatctcgaggcttcaaagcagatgtgctgacagctttcttgaacaaggtgtacaagagatccaag

SEQ ID NO: 872 - DNA, 1047 bp, Neosartorya fumigata
atggccaccaccacctcccgagcggcgtttgaggccgtctttcccaccctggctgaggatctgctggcacacgcgaagaagtataacttgccagagaacgccgtcaaatggttcgaacaggtgctgaacgttaatgtgccaggaggtaagctgaacagaggactaagtgttcccgacacgggaatcgcgctccttcagaagccgctgaccgacgagcagttcaagcacctgtcgattctgggttggctgacggaacttctgcaagcattctttctcgtctctgacgacatgccctgtattgactcttctattactcgtagaggacagccctgttggtacagacaccccggtgtcggactgattgcgattaacgatgcttttatgctggagtcgggcatctacgtgatcctgaagaagcactttcggtcccaccccgcttacgtggacttcctggagctctttcatgagaccacttggcaaacagagctgggccagctgtgcgacctcattacggcaccggaggacaaggtagatctcgataactttagtatggaaaaatacatgtttatcgtgacgtacaagactgcttactattcattctacctccctgtcgcgctggcgctcctctacctggaacttgccacccccgagaatttacagcagacccacgacatcctgatcccattgggtcagtacttccaggtgcaggacgactatctggatgcatacggcgaccccgcagttattggaaagattggcaccgacattcaggataataagtgttcctggttgatcaaccaggcccttcagcgatgtaacaccgagcaacgaaagcttttggatactgcctacggacgtaaagactccgaattggaggccaaggttaaggccctgtataaggagctcgatcttgagaaggtctataaggagtacgaggagaagactgtcggagaaatccgtcgaaagattgctgccattgacgagtcgcagggacttaagaaggaggtcttcgaggccttcctcgggaagatttacaagcggactaag

SEQ ID NO: 873 - DNA, 1095 bp, Catharanthus roseus
atgtgcgtgagttccgccctggccaacgtcggccagcaggtgcaacggcaatccaactcggtcgccgaggagccactggaccccttcagcttggtcgccgacgaactgtctatacttgctaaccggctccgatccatggtggtagccgaagtccctaagctggcctcggcagccgaatatttctttaagttgggggtggagggtaagcgatttcgaccaaccgtcctcctgctcatggccacagctattgacgctcccatttcgcgaacccctccagacaccagtctagacacactgtccacggagctgagactccgacaacagtcgattgctgagattactgaaatgatccatgttgctttcttactgcatgacgacgtgcttgacgacgccgagacccgacgaggtatcggctccctcaacttcgtgatgggaaacaagctggctgtgctggcaggagactttctactctctagagcatgcgtagctctcgcgtcactaaagaatactgaggtcgtgtcgttgctagccactgtcgtggagcatctcgtgacaggagagactatgcaaatgacgacaacttccgaccagaggtgttcgatggagtactacatgcagaagacctactacaagactgccagtttgatttcgaactcctgcaaggccattgccctactggctggccagacctctgaggtggccatgttggcatatgagtatggaaaaaacctcggactcgcattccagctcattgacgacgtcctggactttactggaacttcggcatctctgggtaagggatctttatccgatatccgacacggcattgtgactgcaccaatcctgtttgctatcgaagagttccctgagcttagggctgtcgtagacgaaggcttcgaaaacccctataatgttgatctcgctctccattacctgggcaaatctcggggcatccagcgaactagagagctcgctattaagcatgccaacctagcttctgacgctattgactcgcttcccgtgactgatgatgaacacgtgctacgatcgcgacgggccctggttgagctgactcaacgagtaatcacccggcga

SEQ ID NO: 874 - DNA, 1101 bp, Catharanthus roseus
atgtgcgtttcttcggctcttgcgaacgtgggccagcaggtgcagcgacagtctaattctgtggccgaggagccattggatcctttctcgctggtagccgacgagttgtctatattagctaaccgactccgatccatggtggttgctgaggttcctaagctggcctctgcagccgagtacttttttaagctgggcgtagagggcaagagattccgccccacggtactgttgctcatggctaccgctattgacgcaccaatctcgcgaaccccgcccgacacatccttagacactctcagcacggaattgcgattgcggcagcaatctattgccgagattaccgaaatgattcatgtggcattcctgctccatgacgacgttccttgcatcgatgacgcagaaaccagaagaggcatcggttcgcttaactttgtgatgggcaacaagcttgctgttttggccggcgactttctactgtcccgagcgtgtgttgctctcgcaagcttaaagaacacagaagtcgtgagcttattggctacagtcgtcgagcacctggtcactggtgagactatgcagatgaccaccacttctgatcaacgttgttctatggaatactacatgcagaagacttactataagactgcctccctaatctccaacagttgcaaggcaatcgctctgctagccggtcagacctctgaggtcgccatgctcgcttacgagtacggtaaaaacctaggcttggcctttcagcttatagacgacgtcctggactttactggaacatcagcttccttaggcaagggctcgctctctgatatccgacacggtatcgtgaccgcgcccatcctgttcgccattgaggagttccccgagcttcgcgccgtagttgatgaaggattcgagaacccctataatgtcgatctggcgctgcactacctcggaaaaagccgtggaatccagcgaacgagagagctcgccatcaagcacgccaacttggcttctgatgctattgattctcttcctgttaccgatgacgagcatgtgctcagatcccggcgggctcttgttgagctgacacaacgagttattacccgtcga

SEQ ID NO: 875 - DNA, 1101 bp, Catharanthus roseus
atgtgcgtttcctctgcccttgccaacgtcggacagcaggttcagcgccagtccaactctgtcgctgaagagcctctggatccgtttagcttggtggcagatgaattatcgatcctcgccaacaggctgcgatctatggtggtggctgaagtgcccaagttggctagtgcagccgagtactttttcaagttgggtgtggaaggaaagcgattccgacccaccgtgctattgctcatggctacagctatcgacgctccaatttctcgaactccgcccgacacatcactggacaccctgtctactgagctacgactgcgacagcagtctattgcagagattaccgaaatgattcacgtagcctccctattgcatgatgacgtcccttgtattgatgatgccgagacccgacgaggaattggcagtctgaattttgtcatgggaaacaagcttgccgtcctggccggagatttcttgctttctcgagcctgtgtggctttggcttccctgaagaacaccgaagtggtatcacttcttgctactgtcgtggagcatttggttaccggggaaaccatgcagatgaccaccacttcagaccagcgatgttccatggaatactacatgcagaagacttactataagactgcttcgcttatctcgaactcttgcaaagctattgcccttttagccggacagacctctgaggtggccatgctcgcatacgagtacggaaaaaacttgggactagcattccaattgattgatgatgtgctggacttcacgggcacttccgcctctttgggaaagggctcgcttagcgatatacgtcacggtatcgtcacagcccctatcctgtttgctatcgaggagttcccggagctgcgagccgtggtcgatgagggattcgagaacccttacaacgtggacctggctctccattaccttggtaagtccagaggaatccagcgaacacgagagcttgccattaagcacgctaaccttgcgtcagacgccattgattccctccccgtaacggacgacgagcatgtccttcgatctagacgtgccctggtcgagctgacccagcgtgttatcactcgacga

SEQ ID NO: 876 - DNA, 912 bp, Rhizobium acidisoli
atggacgctaatcgtgacacctttgagacacgactgaagaacaatgcacgggagatcgaggcgctgctggatgccctcctcctgccgaacgctctgtctgacgaaattgctcgacctgagaccctgcgatctgctatgcattacgcggtactcaacggcggtaagagactccgacccttcctggtggtcgagtcagccgctctactgggcggcgacgatgaggccgctcgacgggtgggcgctgctctcgagtgtgtccattgctactttctcgtgcatgacgacctccctgccatggatgatgacgaccttcgacgtggcaaacccactgtccacattaagtttgacgaagccaccgcgatcttggccggagactctctcctgacgtacgcttttgatatcattgccgcccccgagaccgccttggctgatacgtcgaaggcttccctagttcttgccctggctcgagcggccggcctggggggcatggctggaggtcaggccctggatctggctgctgagaagcaagcccctgatgaggcgggcattatccgtcttcaggctatgaagacgggagccctgatccgattcgcttgcgaggctggcgcgctcatcgctgcttctccccccgaagacagacgacgtctgcgagcgttcggcgaaaagatcggactggcctttcagctggcggatgacatccttgatttgacctcagatactgctaccatgggaaaggccacaggcaaggacgccgcacgaggaaagggcactctggttgcgctgcatgggattgagtgggccgaagagcagcttagacaacacgtgcgtgacgccgaggctcttcttgcgccctacggcgctcgtgcttctactctgattgcggctgctcatttcattgctgatcgaaagtcc

SEQ ID NO: 877 - DNA, 897 bp, Escherichia coli
atggacttccctcagcagctggaggcctgtgttaaacaggctaaccaggccctttcgagattcattgcacctctgccatttcagaacaccccagttgtcgagactatgcagtacggggcgctcttgggtgggaagcgactacggccatttctggtttacgccaccggtcatatgttcggcgtgtccaccaatacactggacgctccagcagctgctgtggaatgtattcacgcctacttcctgatccacgacgatttacccgccatggatgacgacgacctccggcgaggcctccccacttgtcacgttaaattcggcgaggccaacgctatactggcgggagatgcgctgcaaacccttgctttttcgatcctgtccgatgcggacatgcctgaagtctctgatcgtgaccgaatctccatgatctctgagcttgccagtgcgtcaggtattgcaggcatgtgcggtggccaggctttggacttggatgcggagggcaagcacgttcccttggatgctctcgagcgaatccaccgccataagaccggtgcccttatccgagccgcggtccgactgggagcactaagcgccggcgacaagggtcggcgagctttgcccgtcctggataagtacgctgagtccatcgggctcgcgttccaggtccaagacgatatcctagacgttgttggagacaccgccactctcggcaagagacagggagccgaccaacaattgggaaaatccacctacccagctctgctgggtctcgagcaagcccgaaagaaggcacgcgaccttatcgatgatgctcgccagtcgcttaagcagctggcagagcagtcccttgacacttctgccctagaggcccttgctgactacatcatccaacgaaacaag

SEQ ID NO: 878 - DNA, 912 bp, Brucella suis
atggagaagctccctgtggactttacgacgttacttaatcggcgagccatggaggtcgaagccgccctggctggactgctcgatgagtgcccccgaacaggcgagatcgctagacctcagcggttgattgcggccatgcgacacggcgtgctgaatggtggaaagcgtctccggccctttctagtgctggagtctgccgctctttttggtcagtatggtcaggctgtgttacgagtagccgctgccctagagtgtatccactgctacttcctggtccacgacgacctgcctgccatggacgacgacgacttgagacgagggcagcctaccgtccataaggctttcgacgaggctgccgccatccttgcaggagactccctgctgacttacgctttcgacatcatagcttctgacgaaaccgagctggacgccacaacccgaatcaagctggtctgtgctttgactcgggcctcgggcctaggcggaatggcgggcggccaagccctcgacctgatggctgagaccagaaagcccgacgaagccggaatcatcacactgcaggctatgaagacgggagccctcatcagattcgcttgtgaggccggtgctatcatcgccggcgcttctcaagaggacagagaacgcatggcggagtttggctccgcgattggactcgctttccagttggcggacgacttgctggatgtaaccgcagacgccggaaccatgggaaaggccaccggaaaggacgcggctgccggtaaggccactctcgtttctctccacggaatcgactggactaggcagcagctatcgggcctggtcgctcaagcggagagcctcctagctccattcggagaggacgccgagccgctgaaacaggctgcccgatttatcgccgaacgacaaaac

SEQ ID NO: 879 - DNA, 1017 bp, Arabidopsis thaliana
atgttttcgctggtggccgacgagctgtcgcttctgagcaacaagcttcgagaaatggtcctggccgaggtgccgaagttggctagtgctgccgagtactttttcaagagaggcgtccagggtaagcagtttcgaagcactatcttgcttcttatggccacagccctgaatgtacgggtgccagaggccttgatcggcgagtccacagacattgtgacctccgagctacgagttcgacagcgaggcattgcggagatcaccgagatgattcatgttgcctttcttcttcacgacgacgttctcgacgatgccgatacgcgacgaggtgtgggttcccttaacgtcgtcatggggaacaagatgtccgtcctggccggagatttcctcctgagcagagcctgtggagcactggcggccttgaagaacaccgaggtggtggctctgctggctaccgcggtagagcacctggtaacgggagaaaccatggagattacctcctctaccgagcagcggtactctatggactactacatgcagaagacctattacaagactgccagtctaatttcaaacagctgtaaggctgtggctgttctcaccggacaaaccgcagaagttgcagtgctcgcattcgagtacggtcggaatctcggcctggcctttcagctcattgacgacatactggactttaccggcacctcggcctcgttaggcaagggctctttgtctgatattcggcatggcgttatcactgctccgatcctcttcgccatggaggaattcccgcagctccgggaagtggtggaccaggtggagaaggatcccagaaacgtggacatcgctctggaatacctcggcaagtcgaagggcatccagcgagccagggaactggcgatggagcacgccaaccttgccgccgctgccattggctctctccctgaaacagacaacgaggatgtaaagcgctcccggagagctctgatcgatctcactcaccgcgtgatcacgcgaaacaag

SEQ ID NO: 880 - DNA, 1023 bp, Arabidopsis thaliana
atgttttcactggtggccgacgagctctcgctcctgtctaataagctccgagagatggtcctggctgaggtccccaagcttgcctcggcggctgagtatttcttcaagcgaggcgtccagggcaagcagtttagatctacaattctgcttctgatggctaccgctctgaacgtccgagtccccgaggctctcatcggagaaagcaccgacatcgtgacctccgaactccgagtgcggcagcgtggcattgctgagatcactgagatgattcacgtcgcttttctgctgcatgacgacgtcccctgtattgacgacgccgatactcgacgtggagtcggcagcctaaatgtcgtaatgggcaataagatgtctgtactcgcgggagacttccttctgtctcgagcgtgcggtgccttggccgccctgaagaacaccgaggtggttgcgctcctagcgacggctgttgagcacttggtcactggagagactatggaaattacatcttccacagagcagcgatactcaatggactactacatgcaaaagacctattataagaccgcatcgctgatctccaacagctgtaaggcggtggcagtcctgaccggtcagaccgccgaggttgctgtgctggctttcgaatatggtagaaacctgggactggcatttcaactgattgacgacattctagattttacgggtacctcagcctctctgggaaaaggcagcttgagtgatattcggcacggtgtcattacggcccccatcctgtttgctatggaggagtttccacagctgcgagaagtggttgaccaagtggagaaggacccacgaaatgtagacatcgcgctcgagtacctgggaaagtctaagggcatccagcgagcgcgggagttggccatggaacacgccaaccttgcagccgccgctattggttcccttcccgagaccgacaatgaggacgtgaagcgatcgcgacgcgccctgattgatctgacccaccgcgtcattactcgtaacaaa

SEQ ID NO: 881 - DNA, 1023 bp, Arabidopsis thaliana
atgttttctctggtcgctgatgaactgtccttgctcagtaacaagcttagagaaatggtgctcgctgaggttccgaagttggccagcgccgctgagtacttttttaagcgaggcgtgcagggaaagcagttccgatccacaattctcctgctgatggcaacagcgctgaacgttcgagtccccgaggctctcatcggcgagagtacggacatcgtgacttctgagctgcgagttaggcagaggggaatcgcagagatcaccgaaatgattcacgtcgccagcctgcttcatgacgatgtcccttgcatagatgatgccgacacacgaagaggagtcggatccctcaacgttgtgatgggtaataagatgtcggtccttgcgggagactttctgctgtctagagcttgtggtgctttggcagcgctgaagaacactgaggttgtcgccctgctcgccaccgcagtcgagcatctcgtcacgggcgagacaatggaaattacgtcatctactgagcaaagatacagtatggattactacatgcagaagacctattacaaaacagcatcacttatctctaactcctgcaaggccgtggccgtgctgacaggacagaccgccgaggtggccgttctggcttttgagtacggacgaaatctagggctcgcttttcagctgatcgacgatattcttgactttacgggaacctctgcttctctgggaaagggaagcctcagcgatattcgacacggagtcatcactgctccaatcttgttcgctatggaggagttcccccagttgagagaggtcgtggaccaggtcgagaaagacccacgaaacgtcgacattgctttggagtacctgggcaagagcaagggcatccagagagcccgagagctcgcaatggagcacgcgaacctcgctgctgcagctattggatctctgccagagaccgacaacgaagacgtcaagcgatcgcgaagggctctgattgacctcactcatcgagtcatcacccgaaacaag

SEQ ID NO: 882 - DNA, 846 bp, Buchnera aphidicola
atgcacttcttccacctatacgagcgatacaagcaccgaatcaatcagaagctcttctacacattgaatcagcttcccttccagaagagctccctgctcaaagcaatgaagtactctgttttctctggatccaaaagacttcggtccagcttgatttattctacgggcgacgtgttcaaggtgaacatcactaccctcgacgtcatctcgaccgccatcgaattcatccattcttactttctgatccacgatgacctcccctgcatggataacgacaacttccgtcgaggcaagatctcttgtcacgtaaagtatggcgaatctacctcgctgctcgccggtgacgctctacagagcctggcttttaacatactttcaaactcatttatgcccaacgtgtctaacctgaagcgcattaagatgatctcggagctgtcctactccattggatcttccgggatgtgtatgggccagaacctggaccttgaggccgagaagaaggatgtcaacctctccgaattggagattattaacctgtacaaaacgtctttcctgatgcgttctgctgtgagactggtgtatttttcctccaacaacttcagtaagtctattctgtcgattctcgatctgttctctatctctattggcctagctttccagatccaggacgacatcctggatttcaaaaaggacagcgttaagactgataacaagaagatcattaagaagcacacctaccccctgattattggactggacgagtcacgcaaaaagattaagcaactgcataagaagtcttttctcgccctgaattcgttgaagaagaagatctctatcccgacctac

SEQ ID NO: 883 - DNA, 1071 bp, Dendroctonus ponderosae
atgatccgacccgttcagtcgtccgccctggtcacaaaagagcagtctcgagacttcatggccctgttcccggacctcgtccgcgaactgactgaagtgggcaagtcgcaggagttgcctgacgtcatgcgaagattcgcccgagtgctccagtacaatacccccaccggaaagaagaatcggggacttatcgttttgtctacctaccgaatgcttgaggatccagagaagctcactcccgagaatattcggctggcctctatcctaggatggtgtgtcgagatggtccacgcttatttcctcatcctggatgacattccgtgcatcgatggctcagagacacgaaggggcgccctctgctggttccgacagtcaggtattggccttactgcagtcaacgacgccgtgatgatcgagaacgccgtttacttgctgatcaaacgacatctcaaagaccatcccatgtacgtccccctcatggagctttttcacgagggaaacctgaagactacccttggccagtctcttgatgctatgtgtctggacacaaatggtaagcctaagcttgacatgttcacaatgtcccgatacacgtctatagtgaagtataagactgccttctactcgtttcagatgcccgtcgccatcgccatgtacctggctggaatgagcgacgaagagcagcaccgacaggcaaaaactattctcatggagatgggtcagttcttccagattcaagacgacttcctggattgtttcggagaccctacagtcactggaaaggtgggcacggatatccaggacggcaaatgctcttggcttgcagtggtcgctctccagagggcctcccccgcccaaagaaaaatcatggaggagcactacggtaggcctgagcccgagtcgattgcccgaattaagaatctgtacgtcgatctgtgtctccctaacacctatgccatttatgaggaggaaagtttcaatatcattaagacccacatccaacaaatttcaaagggtcttagacatgacctgttctttaagattatggaaaaaatttacaagcgagagtgt

SEQ ID NO: 884 - DNA, 942 bp, Picea abies
atgaaggccctggttcagctcgctgacctttcagagcaggtgaagaacgtggtggagtttgacttcgacaaatacatgcactccaaggctatcgcggtcaatgaggccctggataaggtcattcccccccgttatccgcagaaaatctacgagtccatgagatactctcttcttgccggaggcaagcgggtgcgacccattctctgcattgcggcgtgcgagctgatgggcggaacagaagaattggccatgccgaccgcctgtgccattgaaatgattcacaccatgtttttaattcacgatgatctgccgtacatcgacaacgacgatcttagacgaggaaaacccactaaccacaaggtcttcggcgaggacactgccattattgctggtgatgctctgcttagcctggcattcgagcatgttgccgtaagtacctctaggacgctgggaaccgacattattctccgtttgctgtctgaaatcggccgagcaaccggttcggagggtgttatgggtggacaagtggttgatatagaatctgagggcgaccccagcattgacctggaaacactggagtgggtccacatccacaagactgccgtactcctggaatgctcggtcgtgtgcggcgccattatgggcggggcttcggaggacgacattgagcgagcccgacgatacgcacggtgtgtcggcctgcttttccaggtggttgacgacatcctggacgtgtctcagtcgtcggaggagctcggtaagactgccggaaaggacctaatttctgataaggcgacttatcctaaattgatgggactggagaaggctaaggagttcgcagacgagcttctcaatcgagggaagcaggagctaagctgtttcgacccgacgaaggctgctcccctcttcgccctcgcagactacatcgcctctaggcaaaac

SEQ ID NO: 885 - DNA, 900 bp, Abies grandis
atgaaggccgttgagttcgacttcaacaagtatatggactctaaggccatgaccgttaacgaggccctgaacaaggccattcccttgcgttacccccagaagatctacgaatcgatgcggtactccctgttggccggtggcaagcgggtgcgccccgtcctgtgcattgccgcttgcgagttggtgggcggcactgaagagctcgcaattcctactgcatgcgctattgaaatgatacacactatgtttctcatgcatgacgatcttccttgcattgataatgacgatcttcgacggggtaagccgactaaccacaagattttcggtgaagacaccgctgttacagctggtaacgcccttcactcttacgcctttgagcacatcgccgtatcgacttccaagacagtcggcgcggatcgaatattgcggatggtttccgaacttggacgagccaccggaagcgaaggtgtgatgggaggtcagatggtcgatattgcttcagagggtgacccttctatcgaccttcaaactctcgaatggatccacatccacaagaccgcaatgctgctggagtgttctgttgtctgtggcgctattatcggaggcgccagtgaaatcgtgattgaacgcgcccgcagatacgcgcgatgcgtgggtcttctcttccaggtcgttgatgatatccttgatgttactaagtcgagcgacgagctgggtaagacggccggtaaggacctgatctctgacaaggctacttacccgaagctgatgggactcgagaaagccaaggagttttccgacgagcttctcaaccgcgctaagggtgagctctcatgctttgatccagtcaaggcagctccactgctgggtcttgctgactacgtggcattccgtcagaat

SEQ ID NO: 886 - DNA, 1119 bp, Corynebacterium glutamicum
atgaaagatgtgtcgctctcttctttcgacgcccatgacctggatctcgataagtttcctgaagtggttcgggatagactcactcagtttctcgacgctcaggaactgacgatcgctgacattggagctccggtcactgacgccgttgcacacttgcgaagtttcgtgctgaacggaggcaagcgaattagaccgctctacgcatgggcgggatttctagcagcgcaagggcataagaattcttccgaaaagcttgagtctgtgctcgacgccgcagcttcactggaattcattcaggcctgtgccctgatacacgacgatatcccatgcatcgactcttcggatacccggcgaggcgcgcccacggtgcaccgagccgtggaggcggaccaccgagccaacaacttcgaaggcgaccctgaacatttcggcgtgtctgtttccatcctcgctggtgacatggccctggtgtgggctgaggatatgttacaggactccggcctgtcggctgaggcgttggcacgaacacgtgacgcttggagaggcatgcgaaccgaggttattggaggccagttgctcgacatctatcttgaatctcacgccaacgagtccgtggagcttgcagactccgtcaaccggtttaaaactgcagcctacacaatcgctagacctttgcacctcggcgcatccattgctggcggttcgcctcagctgattgacgctctactccactacggccatgacatcggaatcgccttccagctgcgtgacgatctcctgggcgtattcggagaccccgctattaccggtaagccagcaggtgacgacatccgtgagggcaagcgtactgtgctcctggccctcgcattgcaacgagccgataaacagagtcctgaggccgccaccgctattagagcgggagtcgggaaggttacatcccctgaggacatcgctgtcatcactgagcacatccgagcaaccggcgctgaagaggaggtggagcagcggatatcccagctgacagaatcgggtctcgctcaccttgatgatgtggatatccccgatgaagtccgagcccagctgcgagcactcgccattcgctccacagagcgacgaatg

SEQ ID NO: 887 - DNA, 1041 bp, Vitis vinifera
atgcttgccgaggagcagctggatccgttcagcctggtggccgacgaactatccctgctggcggacagactcagatctatggtcgtggcggaagtgcctaagctcgcttctgctgctgaatactttttcaagatgggcgtggaaggaaagcgtttcagaccgactgtgcttctgcttatggcgaccgcgcttaatgtccctctcccccgacccgccctggccgaagtcccagaaaccctctctaccgaactgcgaacccggcagcagtgcatcgctgagatcaccgagatgatccacgtggctttcttactgcatgatgatgtgcttgacgatgctgagacccgccgagggatcggttccctgaatatcatgatgggtaacaaggtggcagtgttggccggagactttctgttatctcgtgcctgtgtcgccctggccagtctgaagaacactgaagtggtgtccctgttggctacagtggtggagcaccttgttacaggcgagacgatgcagatgacttctacaagcgagcagagagtgtcgatggaatactacctccagaagacctactacaagaccgcatcgctgatctccaactcatgcaaggcgattgcactgttggccggccagaccgctgaggtgagtatgttggctttcgagtacggcaagaatctcgggctggcttttcagctaattgatgacgtccttgattttacaggaacttctgcgtctctgggaaaggggtctctgtcggacattagacacggaatcatcaccgctcccattctcttcgccatcgaggagtttccccagctcgacgccgtcgtgaagcgaggactcgataacccggctgatatcgaccttgctctagattacctgggaaagtcccgaggcatccagcgtactagggagctggccatgaaacacgccaacctggccgccgaagctattgattctctccccgagagcggcgatgaggacgtgctgcgatcccggcgggccctgatcgaccttacccaccgggtcatcacccggacaaag

SEQ ID NO: 888 - DNA, 1047 bp, Vitis vinifera
atgctcgccgaggagcagttggaccctttttctctagtggccgacgagctgtctctcctggccgatcgactgagatcaatggtcgtcgccgaggttccaaagctggcttctgccgccgaatacttcttcaagatgggcgtcgaaggcaagagatttcgtcctacagtgctgttgctcatggccacagctctcaacgtgcccctgccccgccctgctctggcggaggttcctgaaactctgagcacggagctgcgtacccggcagcagtgtatcgctgagatcaccgagatgattcatgttgcttttctccttcatgatgatgtaccctgtattgatgatgcggaaacccgaagaggtattggtagcctcaacatcatgatgggcaataaggtggccgtgctggccggtgatttcctactcagcagagcatgtgtggcgctcgctagcctcaagaacaccgaggtggtctcgctgctggccaccgtcgttgaacacctcgttaccggcgagactatgcagatgacctccacgagtgagcagcgagtttcgatggagtactatctccagaaaacttactacaaaacggcgtcgttgatcagcaactcgtgtaaggcaatcgccctgctcgctggccagaccgctgaggtttcgatgctggcgttcgagtacggcaagaaccttggactggcattccagctgatcgacgacgtcctcgatttcaccggcacaagcgcatccttgggcaagggatccttgtccgatattcgacacggaattatcaccgccccgattctcttcgccatcgaagagttcccacagctcgacgctgtggtgaagcgtggcctggataaccctgccgacatcgatctcgccctggattacctgggcaaatcacgaggcattcaacgcacccgagagctcgccatgaagcacgccaacctggccgcagaagccatcgactctttgcccgaatccggcgacgaggacgtgctgcgctcgaggcgagctctgattgacctgactcatcgcgtgatcacccggacgaaa

SEQ ID NO: 889 - DNA, 1047 bp, Vitis vinifera
atgctggcagaagagcagctggacccattttccctggtggccgacgagctttcgcttctggccgatcgactgcggagcatggttgtcgccgaggtccccaagctggcttctgccgcagaatactttttcaaaatgggagtggagggcaagagatttcgacccacggttctcctgcttatggccacagccctgaacgttcctcttcccagacctgcgctggctgaagtgcctgaaaccctctccaccgagctgagaacccgtcaacagtgtattgccgaaatcaccgagatgatccatgttgcctccttactccacgatgatgtgccttgcattgacgatgcagagacgcgacgaggtatcggatctctcaacatcatgatgggcaacaaggtcgctgttctcgccggagacttcctcctgtcccgggcttgtgtggccctcgcttcgctcaagaacaccgaggttgtctcactgctggctaccgttgtcgagcacttggtcacgggagaaaccatgcagatgacatccacttctgagcagcgagtctccatggagtactacctccaaaaaacatactataagactgcctccctaatctctaactcttgtaaggcgattgcccttcttgctggtcagaccgccgaggtaagtatgttggcatttgagtacggtaaaaacctgggcctggctttccagctcattgacgacgtcctagacttcacaggaacctccgctagcctggggaagggttcgttgagcgatattcgccacggaatcatcactgcccctatcctgttcgctattgaggagtttcctcagctcgacgccgtcgtgaagcgaggacttgataaccccgccgacatcgatctagctctcgattacctgggtaagagccgaggaatccagaggactcgggagctagctatgaaacatgctaacctcgcagccgaggccatcgattccctgcccgagtctggcgacgaggacgtgttgcgctcccgtcgcgctctgatcgatttgacacatcgcgttatcacgcggacaaag

SEQ ID NO: 890 - DNA, 957 bp, Picea abies
atgctccgctgcagcaacactaacgctcagctggctaacctcagcgagcaggtgaagggcaaggtgactgaattcgactttaaggaatatatgcgatccaaagcgatgtccgttaacgaggccctggatcgtgctgtgccgctgcgataccctgagaagattcatgaagctatgcgatactctctcctcgccggcggcaagagagtacggcccattctctgcattgccgcctgtgagcttgtgggaggtagcgaagaattagctatgcccaccgcttgcgctatggaaatcatccatactatgttccttatccatgatgatctgcctcccatggacaacgatgacctccgaagaggaaagcccactaaccataaagtgtttggagaaggcacagccgttttagctggcgatgctctcctctcattcgccttcgagcatattgctgttagtacatccaagaccgtcgaatctgaccgggtcctccgagtggtctcggagctgggaagggctattggctcggagggcgtcgctggcggacaagtcgccgatattactagtcagggcaacccttcggttggactggagaccctcgaatggatccatatccacaaaaccgctgtcctcctggaatgttctgtggcatccggagccatcattggcggagcatccgacgacgagatcgagcgcgtgcgaaagtacgcccgatgcgtgggtcttctatttcaggtggtggacgatatcttggacgtgaccaagtccagcgaggagctgggaaagactgccgctaaggatctccttagcgataaggctacatacccgaagctgatgggactcgagaaggctaaggagttcgcagacgagctgctaggtaaggctaaagaagaactgtcctttttcaaccccaccaaggccgctcctctgctgggcttggctgactacattgctcagcgtcagaac

SEQ ID NO: 891 - DNA, 1065 bp, Sus scrofa
atgaacggcgaccaaaagctggacgcttacgctagagagcgccaggactttattcagcacttctcacagattgttaaggttcttactgaagaggacatcgggcaccctgagattggcgacgctgtagcacggctgaaggaagtgctggagtacaacgttgttggtggtaagtacaaccgcggcatcacagtcctggttgtcttccgagagctagtggagccccgaaaacaagacgctgattccctccagcgagccctgacagtcggttggtgcatcgaactcctgcaggcctttttccttgttgctgatgacatcccctgcatcgactcgagcctgactagacgaggacagacttgttggtaccgtaagcccggcattggccttgacgctattaacgatgccttcctgcttgaggcctgcatttaccgactcctcaaattttattgtcgagagcagccctactacttgaacctgattgagctgttcctccaaacttcctacaacacagagattggtcaaacactcgacctgatcgccggtcctcagggaaacgtggatctgtccagattcaccgagaagagatacaagtctatcgttaagtataaaactgctttctactcattctaccttccggttgccgcagccatgtacatggctggaattgacggcgagaaggaacacgccaacgccaagaagatcctaatggagatgggtgagttctttcagatacaagatgactacttggatctgttcggcgatccttctgtcaccggcaaaatcggtaccgatatccaggacaacaaatgtagttggctagttgttcagtgtctgcaacgagcgagtcctgaacagcgacagatcctgcaggagaactacggccagaaggacgcagaaaaggttgcgagagtaaaagctctttacgaggagatgaaccttcaggcggttttccttcagtatgaagaggactcttactcgcacttgatgggactgatcgagcagtatgcggcccctctcccccccgctattttcctggaattagcccacaagatctacaagcgacggaag

SEQ ID NO: 892 - DNA, 1065 bp, Acyrthosiphon pisum
atgcccgtcattaccgggaccgccgtctccaaggacgagacccgagatttcatggccgtctttcctgacgtggtccgagacctcaccgatacgggtaggaacctcgacgtcccagatgtgaccaagtggctggctaaattgttgcaatacaacgtcccgggtgggaaaaagaaccgaggactggccctggtgctgtcctacaagatgctctcttcccctgcagaccaaacagacgaaaatattagacttagctacattcttggctggtgcgtcgagattctccaggcttaccaactagtgctcgacgacattccctgcatcgataatgcgattactcggcggggtcggccatgttggtaccgacacaacgacataggtctgatggctgtcaacgacggtgttcttctggagcagagcatataccagcttatcaagaagtacttcaaggacaagccttattatacccatattctcgagctgttctacgacgtgaccatgaagacttccatgggtcaatgcctcgacatgctgacggccaactcctttaagtccaagaagctcgagaagtacactatggagaactacacggctattgttaagtacaagacagcttactacagcttctttctccccgtgtgcctcgctatgcgtatgaccaatatcaacgaccccgagattttccgacaggccaaaactattctgcttgagatgggccacttcttccaagtccaggacgactttctggattgctacggtgaccccgacgtgatgggtaagatcgggaccgacattgaggacgggaagtgttcgtggctggcagtggtcgccctccagaaggtgaactctgagcaaaagaagattatggaggacaactacggtatagacaacccagcgaacgtggccgttatcaaggacctctacgctcaattaaagctgcctgacacgttccacttgtacgaggaggaatcttacaaattgatctgcacgcatatccagcaactgtcgcgtggtctatcccaagacatgttcttcaaattcctcgagaagatttacaagcgaacgctc

SEQ ID NO: 893 - DNA, 1077 bp, Mycobacterium tuberculosis
atgcggggtactgacgagaagtacggcctgcctccccaaccagactcggatcgaatgacccgtcgaacattgcctgttttgggcctagctcatgagttgattacgcccacactgcgtcaaatggctgaccggttggacccccatatgcggccagttgtttcgtaccatctgggctggtccgacgagcgcggacgccctgtcaacaacaactgtggcaaggcaattcggcccgccttagtgtttgtggcagccgaggctgccggtgccgatccccattcggcaatcccaggagctgtgtcggtggagttggtccacaacttttttctggttcacgatgacctgatggatagagatgagcaccgtcgccaccggccaaccgtatgggcactctggggcgatgccatggctctgttagctggcgatgctatgttgtctcttgcccacgaagtgctccttgattgtgacagcccccacgtcggcgcagcactgcgtgctatctctgaggccacccgagagctgattagaggacaagctgccgatactgctttcgaatctcgaactgacgtggccctggacgagtgcctgaagatggctgagggtaagacggcggctctgatggccgcttctgctgaggtcggcgcgctgctcgccggagcgccccgatcggttagagaggcgctagtggcttatggacgacatatcggcctggcatttcaactggtcgacgacctgctcggtatttggggacgtcctgaaatcactggtaagcctgtgtattctgacctgcggagcagaaaaaagaccctcccggtaacatggacggtagcccatggaggcctggccggacgtcgactggctgcctggctggtggatgagacagggtcgcagactgcctctgacgacgagcttgcagcagtggccgagctcattgagtgtggaggaggacgaagatgggcctcggctgaggccagaagacatgtcacgcagggaattgacatggtagctcgaattggaattccagacagacctgcagccgagctccaggatttggctcattatatcgttgaccgtcaggcg

SEQ ID NO: 894 - DNA, 1083 bp, Mycobacterium tuberculosis
atgcgaggcactgacgagaagtacggactgcctccccagcctgattctgaccggatgactagacggaccctgcccgtcctgggcttggcacatgagcttatcacccctaccctgcgacaaatggcagaccgattggatccccatatgcgacctgtggtgtcctaccatctgggctggagcgatgaacgaggcagaccggtcaacaacaactgcggaaaggccattcggcccgccctggtcttcgtggctgcagaagccgctggggcagacccgcacagcgccattccgggcgccgtctccgtagagctggttcataacttcttcctagtacatgacgaccttccttgcatcgaccgagacgaacaccggcgacacagacctactgtatgggccttgtggggcgatgcaatggctctgctggcaggagatgctatgctatcgctggctcatgaggtcctgcttgactgcgattcgccacacgtcggcgcagcactgcgcgccatttccgaggcgactcgagagctcattagaggccaggcggccgacactgcctttgagagccgaaccgacgtggcattggacgagtgcctgaaaatggccgagggaaagaccgctgctttaatggccgctagcgctgaagttggcgctctgctcgccggcgctccccgctctgtccgggaggctctggtggcctacggccgacacatcggcctggccttccagctcgtggacgaccttctgggcatctggggacggccagaaatcactggaaagcctgtatacagcgacttgcgatcgcggaagaagactctcccggtgacctggaccgtggctcacggtggcctggcaggtcggcggcttgccgcctggttagtggacgagactggatcacagaccgctagtgacgatgagcttgccgcagtggccgagttgatagagtgcggtggtggccgacgatgggcctccgcggaagccaggcggcacgtgactcaaggcatcgacatggttgcgagaattggcatccctgacagacctgccgcggagctgcaggacctagcgcactacattgtcgaccgccaagcc

SEQ ID NO: 895 - DNA, 1083 bp, Mycobacterium tuberculosis
atgcgaggaaccgacgagaaatacggccttcccccgcaacccgactccgaccgaatgacccgacgaactcttcccgtgctgggcctggctcacgaactcatcaccccaactctgagacagatggccgaccgcctggatccccatatgcgaccagtggtgtcttatcatctgggttggtcggatgagagaggacgacccgtaaacaataactgcggtaaggccattcggcccgcattagtgtttgtggcagcggaggctgctggagctgacccccattccgccattcccggagccgtttctgttgaattggtgcacaacttctctttggtgcatgatgacctgccttgtatcgatcgtgatgaacaccgacgacatcgacctacggtctgggctctctggggtgacgcaatggctctgctcgccggggacgctatgctgtccctggctcacgaggtcttgcttgactgtgactctcctcacgtcggtgccgcccttagagccatcagtgaggctacccgagagctgattagaggtcaggctgccgacaccgccttcgaaagtcgaactgacgtcgccctggacgagtgtctcaagatggctgagggaaagacggccgccttgatggccgcatcagctgaggtgggtgctttgctggccggtgcaccacgatcggtccgagaggcgctggtagcttacggccgccacattggactggcctttcagttggtggacgacctgttggggatctggggtcgacctgagattaccggcaagcccgtttacagcgacctgcgttccagaaagaaaaccttgcccgtcacatggaccgtcgcccatggaggtctcgctggccgccgactggccgcttggctagtcgacgagaccggctcgcaaactgcctcggatgatgaactggcggccgtcgccgagcttatcgaatgtggaggcggaagacggtgggcctccgctgaggcccgacgacatgtgacccaaggcatcgacatggtggctagaattggaatccctgatagacccgctgctgagttgcaggatctagctcattacatcgtggatcgccaggcc

SEQ ID NO: 896 - DNA, 879 bp, Staphylococcus aureus
atgaccaacttgcccatgaacaagctcattgacgaggtcaacaacgaattatctgttgctatcaacaagtctgtaatggatacacagttagaggagtcgatgctgtactcacttaatgctggcggaaaacgaatccgacccgtgctgctgttgctcacactggactccctgaacactgagtacgagctcggcatgaaatcggctattgcacttgagatgattcatacctactttctcattcacgacgacctacccgctatggataatgatgattaccgtcggggcaagctgactaaccataaggtttacggcgagtggacagctattcttgccggtgacgctctgctgaccaaggctttcgagctcattagctctgacgacagactgaccgatgaggtcaagattaaggtccttcagcggctctccatcgcgtccggacacgtgggcatggtcggcggccagatgctagacatgcagtccgaaggccagccaattgacctggagacactagagatgatccataaaactaaaactggggccttgcttacattcgcagttatgtccgcagccgacattgctaacgtggacgacaccactaaggaacacctcgagagctactcttaccacttgggcatgatgtttcagattaaggacgacttgcttgattgttacggtgatgaggcaaagttgggtaagaaggtgggctcagacctggagaataacaagagtacttatgtctcccttctgggaaaggatggtgccgaggacaagctcacttatcaccgagacgctgctgtcgacgagcttactcagattgacgagcaatttaacaccaagcacctcctggagatcgttgacttattctattctagagaccac

SEQ ID NO: 897 - DNA, 891 bp, Picea abies
atggaatttgatttcgataagtatatgcacagtaaggccatcgcggttaacgaggcgttagataaagtaattccaccaaggtatccgcagaaaatttacgagagcatgagatattccctacttgccggtggtaagcgtgtgagacctatactttgtatagcagcgtgtgagttgatgggaggcacagaagaacttgcaatgcccacggcctgcgcgatagaaatgatacacacaatgtcattgattcacgatgatctgccgtacattgataatgatgatttgcgtagaggaaagcccacaaatcataaagtattcggggaggataccgcaataattgccggagatgcactattgtctctggcctttgagcatgttgccgtatcaacctcaagaactctggggacagacatcattctaagactgcttagcgagatcggaagggcgaccggaagcgaaggggtaatgggtgggcaggtcgttgatatagagtcagaaggagatccctcaatagacttggagacgctggagtgggtgcacatccacaagaccgcagtcctgttggaatgttctgttgtgtgcggagcgataatgggcggcgcatctgaggacgatatcgagcgtgcgcgtcgttatgctaggtgtgtcggactgttattccaagtcgttgacgatattcttgatgtttctcaaagttccgaagaactggggaaaacagccgggaaagatttaatttctgataaagcaacgtatcccaagcttatgggtttggaaaaagctaaagaattcgccgatgaacttctgaataggggaaaacaggagttgagctgcttcgatccaactaaagcggcaccgcttttcgccctagctgactacatcgcatccaggcagaac

SEQ ID NO: 898 - DNA, 888 bp, Abies grandis
atgttcgattttaataagtacatggactcaaaggccatgactgtgaacgaggcattaaacaaagcgataccattgaggtaccctcagaaaatatatgagagtatgcgttattctttattggcgggaggcaaaagagtaagacccgtactatgtatagctgcgtgtgagctagtggggggaacggaggaattagcgatcccgactgcctgtgcgatagagatgatccatactatgagcctaatgcatgacgatttgccgtgtattgataacgatgatttacgtaggggaaaacctaccaatcacaaaatcttcggcgaggacacggcggtcacagcaggtaatgctctacactcttatgcgttcgagcacatcgccgtatctacgagtaagactgtaggagccgacagaatattaaggatggtttctgaacttggaagagctactgggagcgagggtgtcatgggcgggcaaatggtggatatagcgtcagaaggagacccatccatagacctgcagacacttgagtggatacatatacacaaaacggctatgctgttggaatgcagcgtggtttgtggagcaatcatagggggggcttccgagatcgtaattgaaagagccaggagatacgcacgttgcgtcgggcttctttttcaagtcgtagatgatatactagatgttactaagtctagtgacgaactgggcaagacagcgggcaaggatctaatttctgataaagcgacgtacccaaagttaatggggctggaaaaagctaaggagttctccgacgaattactaaaccgtgccaaaggagagctttcctgttttgatcctgttaaagccgctcctctgttaggattggcagattatgtcgcatttagacagaac

SEQ ID NO: 899 - DNA, 1080 bp, Catharanthus roseus
atggctaatgtggggcagcaagtccaaaggcagtctaacagcgtagcggaagagccgttggatccattttcactagtcgcagacgaattatccatcttagcgaacagacttagatcaatggtcgtcgctgaggttcctaaattagcctctgcagcagaatactttttcaagctgggcgtagagggcaagagattccgtccgaccgtcctattattgatggctacggctattgacgctccaattagcagaacaccgccagacacctccctggataccctatccactgagctacgtctaagacagcagactattgcggaaatcacgaagatgatacacgtagcctcccttctacacgatgacgttttagatgatgctgagacccgtagaggtataggttcattgaatttcgtgatgggcaacaaacttgctgtgttagcaggtgactttttattgagcagggcctgcgtcgcactagcttcactaaaaaacaccgaggtcgtaagtttgctggcgaccgttgtggagcatttagttactggcgagaccatgcagatgaccacaacctctgatcaaaggtgctcaatggagtactatatgcagaagacatactatatgacagcgagccttatatctaattcctgcaaggcgatagctctattagcgggtcaaacgtccgaagttgcgatgctggcctacgaatatggcaaaaacttaggtcttgcgttccagcttattgatgacgttctagatttcaccgggaccagcgcgagcttggggaaaggttctttgagcgacattcgtcatgggatagttactgctccgatattatttgccatcgaagagtttccagagttacgtgcggtcgttgacgaaggcttcgaaaatccctacaacgttgacttagccttgcattatctaggcaaatctcgtggcattcaaaggacaagagagttagccatcaaacatgcgaacttggcatcagacgcaatcgactcacttccagttacggacgatgagcacgtccttagatccaggagagcattagtagaacttactcaaagagtcatcaccagacgtaag

SEQ ID NO: 900 - DNA, 891 bp, Picea abies
atggagtttgatttcgacaagtacatgcattctaaagctatcgccgtgaatgaagcattggacaaagttatcccgcctaggtatcctcaaaaaatatatgaaagtatgcgatattctttattagctggcggtaagagggtgcgtccgatcttgtgcatagcagcctgcgagttgatgggaggtacggaagaattagctatgccaacagcatgcgcaattgaaatgattcatacgatgtctttgatccatgatgatttgccttatatagacaatgacgaccttagacgcggtaaaccaacaaatcataaggtttttggagaagatacagccatcattgctggagatgccttattgtcgttagctttcgaacatgtcgccgtttcaacaagcagaacgttaggtactgacataatcttgagattattatccgaaataggaagagctacgggttctgaaggtgttatgggcggacaagttgtagatattgaatcagaaggagatccctcaatcgacttggagactcttgaatgggttcacatacataagacggccgttttactggaatgttctgtagtgtgtggtgccataatggggggtgcatcagaggatgatattgagagggcaaggagatacgctagatgtgtggggcttctatttcaagtggtagatgatattctagatgtctcgcaatcttccgaagaacttggtaaaacagctgggaaagacttgatatcagataaggctacttaccccaagttgatgggtctcgaaaaagctaaagagtttgccgatgaattattgaatagaggaaaacaggagctaagttgttttgatcccactaaagcagcaccgttgttcgcattagctgactatatagcgtcgcgtcaaaac

SEQ ID NO: 901 - DNA, 888 bp, Abies grandis
atgtttgacttcaataaatacatggattctaaggcaatgaccgttaatgaagctctcaacaaggccatcccattgagatatccacagaagatttacgaatctatgagatactcattgttagcaggtgggaaaagagttagacctgttttgtgcatagcggcctgtgaattagtaggtgggacagaagaattagccattccaactgcctgtgccattgaaatgatccacaccatgtctttgatgcatgatgacttgccgtgcatcgacaacgatgatttgcgtagagggaaacccactaaccacaagatatttggtgaagacaccgcagtgacggccgggaatgctttgcattcttatgcgttcgaacatattgcagtttctacatcaaaaaccgttggggccgatcgtatattaagaatggtttccgaattaggccgcgccacaggttcagaaggtgttatgggcggacaaatggtcgatattgcttcagaaggtgacccttccatagatctgcagacgctggagtggattcatattcataagacggccatgctgttagaatgcagtgttgtctgcggtgctataataggaggggcttcggaaatagtcatcgagagagcgcgtagatatgccagatgtgtgggtttactgttccaagtagttgatgatattcttgatgttaccaaatcctctgacgaactcggtaaaactgccggtaaggatcttatttcggataaagcaacatatccaaaattgatgggactggagaaagctaaagaattttcggatgaattgttaaacagagccaaaggtgaactatcttgctttgatcccgtgaaggctgctcctttgttagggttggctgattatgtggccttcagacaaaat

SEQ ID NO: 902 - DNA, 1080 bp, Catharanthus roseus
atggctaacgtgggccagcaagtccaacgtcagagtaattcagttgcggaagagccattagacccattttctctggttgccgatgaattgtccattttggctaataggctgagatccatggtagttgcagaagtccctaaacttgcaagcgcagcagaatatttttttaaattgggggtcgagggtaagcggtttagacctaccgtcttgttgttaatggctaccgctattgacgcacctatctcgaggactccgcctgacacttcacttgacaccctatccacagaattaaggttgagacaacagacaattgctgaaattactaagatgattcatgtagcttcacttttgcatgacgatgtgttggatgacgcagaaacgcgtcgaggtatcggatccttaaactttgttatgggcaataaattagccgtattggctggtgactttttgctatctagggcctgcgtagcactagcaagcttaaaaaacaccgaagttgtgtcgttgttggcaaccgtcgttgaacacttagtcacaggcgagacaatgcagatgacaacaacatcagatcagagatgctcaatggaatactatatgcaaaagacctactatatgacagctagtttgatttcaaattcgtgtaaagcaattgcacttcttgctggtcaaacaagtgaggtagcaatgttggcatatgagtatggcaagaatctaggcttggcgttccagcttattgacgatgttttggattttaccggtacctctgcttctctgggaaaaggttcattgtccgacattcgtcatggtatcgtcacggcccccatcctatttgcgattgaagagtttcctgaactaagagccgttgttgatgaaggattcgaaaatccatacaatgtggacctagcccttcattacttaggtaaatctagaggaattcagaggaccagagaactggccatcaaacatgctaatttagcttctgacgccattgattcccttcctgtaacagatgacgagcatgttttgagatctagacgtgccctagttgaattgacccagagagtaataactagaagaaaa

SEQ ID NO: 903 - DNA, 1053 bp, Abies grandis
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagttcgattttaataagtacatggactcaaaggcgatgaccgttaacgaagcgttaaacaaggctattcccttacgatatccacagaagatctatgaatcgatgaggtattcattattagctggaggtaaaagagtcaggccagtcttatgtattgctgcttgtgaacttgtaggtggtaccgaggaattagcaattccgactgcatgtgctatagagatgatacatacgatgagcttgatgcatgatgatcttccatgcattgataatgatgatctgcggcgtggcaaacctacaaatcataagatatttggtgaggataccgcagtcacagcaggaaatgctttgcacagttacgccttcgaacatatagccgtatcaacgagtaaaactgttggggctgatagaatactgagaatggtttcagaattaggccgcgccaccgggtctgaaggagttatgggaggacaaatggtagatattgcgtccgaaggggatccaagtatcgatttgcagacattggaatggatccatatacacaagacagccatgttgttagagtgctccgtcgtttgtggtgccataattggtggtgcttcagaaatcgtcattgaaagagcaaggcgttatgccagatgtgttggactattgtttcaggtagtggacgatattttagatgtcactaaaagtagtgatgaattgggcaagacagctggtaaggacctgatcagcgataaagcaacctacccaaaactcatgggcctggaaaaggccaaggaattttcggatgagctgctaaatagagctaagggcgaactatcctgcttcgacccagttaaagctgcacctttgttgggtttagctgactacgttgctttcagacagaac

SEQ ID NO: 904 - DNA, 1245 bp, Artificial Sequence
  source: /note="Description of Artificial Sequence: Synthetic polynucleotide"
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggaggcaaacgtaggacaacaagtgcaaagacaatctaactcagtcgctgaggaaccgttagatccattctctctggttgcagatgagctatcgattttggctaatcgactaagatctatggttgtcgctgaagtgccaaaactagcgtctgcagcagagtacttcttcaagcttggtgtagaagggaaacgttttcgtcctactgtattgttgctaatggcaacagcaattgatgcccccatttcaaggactcctccagacacttccttagacacattaagtacagaattacgtttgagacaacagaccatcgctgaaattacaaaaatgattcatgtcgcttcacttctacatgatgatgtattggacgacgctgagactcggaggggcataggctccttgaatttcgtcatgggtaacaagttggctgttttggcaggcgattttttattgtctagagcttgtgtggctttagctagcctaaaaaatactgaagtagtaagcttattagcaacagtcgtggagcatctagtcactggtgagacaatgcaaatgaccaccacttcagatcaaagatgctcgatggaatattatatgcaaaaaacatattatatgactgcttcattgatttcgaattcttgcaaggctattgcgttactggccggtcaaacttctgaggtcgctatgcttgcatacgaatacggcaaaaacctcggcttggcttttcaattaattgatgatgtcttagattttacaggtacatctgcttcgcttggtaagggttctttgtcggatattaggcacgggattgttactgcaccgattctatttgcaattgaagaattccccgaactcagagccgtcgttgacgaaggcttcgagaatccttataacgtggatttggctttacactatttgggaaaatctcgcgggatccaaagaacaagagagttggctattaaacatgccaatttggcatctgatgcaattgattctttgccagttacagatgacgaacatgtgttgagatctagaagagcattggtggagttgactcaacgtgttataacaagacggaaa

SEQ ID NO: 905 - DNA, 1056 bp, Picea abies
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggaggaatttgatttcgataagtatatgcattctaaggcaattgccgtgaatgaagcattagataaagtaataccaccccgttatccacaaaaaatctacgaatccatgagatatagccttttggctggcggtaaaagggttagacctatactttgtatagccgcctgtgagttgatgggtggtactgaggagttagctatgccaaccgcttgtgcaattgagatgatccacacgatgagcctcatacatgatgatctaccttatattgacaatgatgacttaagacgtggcaagccaacgaaccacaaggttttcggagaggatacagctattattgcgggcgacgctttgctatctctagcatttgaacatgtagcagtatctacttcccgcactttagggactgacatcattttacgcttattgtcagagataggtcgtgccactggttctgagggagtcatgggtggtcaggtcgtcgatatcgaatccgaaggagatccttcgattgatctagaaacactagaatgggtgcacattcataaaactgcagtattgttagagtgtagtgttgtttgtggagcaattatgggaggtgcttctgaggacgacatcgaacgagcaagacgctacgcaagatgcgtaggtttactattccaagtagttgacgatatattggatgtttcccaatcttccgaagaattagggaagactgcaggtaaagacttaatatcggacaaggcgacataccccaaactcatgggtttggaaaaggccaaggaattcgctgacgagttgctaaatagaggcaagcaagaactgagctgcttcgacccaactaaagctgcccctttattcgccctagcagattacattgcatctaggcaaaat

SEQ ID NO: 906 - DNA, 891 bp, Humulus lupulus
atgtcgacattcaacttcaaatcatatatggtccaaaaagccaactcggttaaccaagccttggatgcagcggttttgctaagggagccacagatgatccacgaagccatgagatacagccttttggctggaggaaagagagtgagaccagtcttatgtttaagcgcatgcgaactagtcggcggagatgaatcagtcgccatgcctgccgcttgcgcagttgaaatgattcacaccatgagtctgatacatgatgacttaccgtgtatggataatgatgacttacgtcgaggcaaacccacgaatcataaggtcttcggtgaagatgtagccgtccttgccggagacgctctactagcatacgctttcgaacatgtggctgtttcaaccgtcggtgtaccagctgctagaattatacgtgctattggcgagctagctaagtctattggcagcgagggactagttgcaggacaagttgttgacatcgactcagaaggattggcaaatgttggattggaacaattagaatttatacatcttcataagaccgctgccttgttagaagcatctgtcgtactaggtgctattctgggcgggggtacggatgaacaagtggaagaattgagatcgttcgcgcggtgtattggactattgttccaggcagttgatgatatcttggacgttacgaagtcaagccaagagttgggtaaaaccgccggtaaagatttagtcgcagataaagcaacatatcccagattgatggggatagaaaagtccagggaattcgcagaaaagttgaaccgcgaggctcaagaacatttaggcggttttgacccgcaaaaggctgcaccactgatcgccctggccaactacatagcatacagacaaaat

SEQ ID NO: 907 - DNA, 783 bp, Humulus lupulus
atggcaagcattacggccgacatcgaagcccacctgaagcaatccattacgctaaaaccaccgttatcggtgcacgaaccaatgtataacctagtattctcggcaccacctaattctgctccgtctttgtgcgttgccgcttgtgaattggttggtggccacagatccaaagcaattgctgcagctagcgccctcagattactgcatgctgctaattttacacatgagcatttacctctcacagattctccttctccatcacctgttatacataatagctatgatccatctatccaattgctgatgccagatgcaatattaccgctaggtttcgaattgctagcacaatcttataacccagctcaaaacaatagtgatagagtgttaagagttatagtcgagtttgctagagcctttggctcaaaggggattttggatggccaatacagacaaagggtagtttctatttccaacggtgatgaagtcgataacgccgaaagggttgattgctcaggaagagaaaaggagggtaaaatgcacgcatgcgcggctgcatgtggagctatactgggtgatgccaacgaggaggaaacagaaaagctcagaacttttggtttatatgttggtatgattcaaggttattcaataaaatttatgagggaaagagaagaagaaaaagaagcagagagaactatcaaagaactaagaaatctagcactgaaagagttagaacactttcatggtagaaaattagagcccatttcctcatttatttattgtctc

SEQ ID NO: 908 - DNA, 891 bp, Mentha x piperita
atgcccgcatttgactttgatggttatatgttgagaaaagctaaatctgttaacaaagcactagaagcagctgttcaaatgaaggagccattaaaaatacacgagagtatgcgatactccctcttggctggtggcaaaagagtaagaccaatgttatgcattgctgcttgtgaactagtcggcggagacgaatcgacagctatgccggctgcgtgcgccgttgagatgatccatacaatgtctttaatgcatgatgatttaccgtgtatggataatgacgatcttagaaggggaaaaccaacgaatcatatggcttttggcgaatcggtcgccgtgcttgccggggatgcattactgtcatttgccttcgagcatgttgccgccgctaccaaaggtgccccaccagaacgtattgttagggtacttggcgaattagccgtctctatcggttcagagggattagtagccggtcaagtggttgatgtttgttctgaggggatggctgaagttgggctagaccatttagagtttatccaccaccacaaaaccgcagccttattacaaggttctgtggtgttaggtgctattttggggggtggcaaggaagaagaggtagccaagctacgtaaatttgctaactgcataggtttactgttccaagtggtggatgatattcttgatgtaacaaagtcttcaaaggaattgggcaaaacggccggtaaagacttagttgcagataaaactacgtatccaaagttgattggtgtcgagaagtctaaagaatttgctgataggttgaacagggaagctcaagaacaattactccactttcatcctcatagagccgctccgctcattgccttggctaactacattgcttacagagacaat

SEQ ID NO: 909 - DNA, 801 bp, Mentha x piperita
atgtctcaaccttactgggctgcgattgaagcggacatagaaagatatctaaaaaaatcaataactattagacctccagaaacagtctttggcccaatgcaccacctaactttcgcagcccccgcaactgctgcttcaaccctatgcctggctgcctgtgaactagttggtggagacagaagtcaagcgatggccgcagcagccgccattcacctagttcatgctgctgcatacgtgcatgaacatctcccacttaccgatggctcccgtcctgtttcgaaaccggctatacaacacaaatacggccctaatgtagaattgttgactggtgacggcattgtcccctttgggtttgaattacttgcaggttccgtggatccagcaaggactgatgacccagataggatccttcgagtgataattgagattagtcgcgcagggggtcccgaaggtatgatttcgggtttgcacagggaagaagaaattgtcgatggtaatacatctcttgatttcattgaatatgtgtgtaaaaagaagtatggtgaaatgcacgcatgcggtgccgcatgtggtgctatccttggtggtgctgcagaagaggaaatacagaagttaagaaattttggcctgtaccaggggactctaagaggtatgatggagatgaaaaacagccatcaactgattgacgaaaacattattggcaaattgaaagaattggcgcttgaagagcttggtggctttcatggcaaaaatgctgagttaatgagttccctggtggctgaaccaagtttatatgctgcc

SEQ ID NO: 910 - DNA, 891 bp, Catharanthus roseus
atgagttcttttgatttcaaagcatacatgataggtaaggcaaatagcgttaataaagcattagaagatgcggttttagtcagagaacctctgaaaattcatgaatcgatgaggtattcattgttggcaggtggtaaaagagttagaccaatgctttgtattgccgcttgtgaactgttcggtgggacggaaagcgtcgctatgccatcagcctgtgcagttgaaatgatccacacgatgtcactgatgcatgatgatctgccatgtatggataacgacgatttaaggaggggtaagccaacaaatcataaagtttttggtgaggacgttgcggttttagcaggtgatgcgctgttggctttcgcatttgagcatattgcaactgccactaagggtgtttcctcagaaagaatagtccgtgttgtcggcgaattagccaagtgtatcggttccgaagggttggttgctggacaggttgttgatgtgtgttcggaaggaattgccgacgtaggactagaacatttagaattcatacatattcataagacagctgctttattagagggttccgttgtcttgggcgctatcgttggtggtgctaatgacgagcaaattagtaagctgagaaaatttgcgagatgtataggtttgttatttcaagtcgttgacgacatcctggatgttactaagtcttcacaagagctgggaaagacagcaggcaaggatttggtcgctgataaagtcacctatccgaagctcctaggaattgacaaatcacgtgagtttgccgaaaaattgaatcgcgaagctcaagagcaattagctgaatttgacccagagaaagcagcgcctttgatagccttagctaactatattgcctacagagacaat

SEQ ID NO: 911 - DNA, 783 bp, Catharanthus roseus
atgaagtctaacagttgggcaaacatagaatctgatattcaaactcatctaaagaagagcattccaatccgtgcacctgaggacgttttcgagcccatgcattatttgacattcgctgcacctcggacgactgcccctgcattgtgtatcgctgcttgtgaggttgtgggaggtgacggtgaccaagccatggcagccgcagccgccatacatcttgttcatgcggcagcttacgctcatgaaaatttgccattaacagataggaggcgaccaaagccgcccatacaacacaagtttaattcgaatattgagctactgacaggtgatggcattgtgccgtacggtttcgaactcctagctaagtcgatggacagcaacaatagtgacagaattttgcgcgttattatagaaataacgcaggccgctggctccaaagggattatcgacggtcagttcagagagttggacgtaatagattccgaaatcaacatggggctaatcgaatacgtctgcaaaaagaaagaaggagaattgaatgcttgtggtgcagcttgcggtgcgatcttaggtgggggctctgaagaagagattggtaaattaagaaagtttggtttatatgctggcatgattcaaggccttgttcacggcgttggcaaaaatcgtgaagaaattcaagaattagttagaaaattacgttacttagccatggaagaactcaaaagcttgaaaaatagaaagattgacactatttcctccttgttggaaactgatttgtgttcagta

SEQ ID NO: 912 - DNA, 891 bp, Nepeta cataria
atggcgccttttaattttaacgcttatgtcgttgagaaagctaacagagtcaacaaagccttagacgatgccgtggaagtaaagaacccaccaatgatccacgaagcaatgagatactcgctattagccggtggtaaacgtgtacgtccaatgttatgtatagcagcttgcgaaatagtgggtggccatcagtcagcagccatacctgccgcctgtgcagttgaaatgatccatacaatgtctctaatacatgatgatcttccatgcatggataacgatgacttgagaagaggtaagccaacaaatcacaaagtttttggtgaggaggtagctgttttggctggtgatgccctgcttgcttttgcttttgaattcatcgctactgccacagttggtgtggcagctgaacgcattctggctgctgttggtgaattggccaaggcgattggtactgagggtttagtcgctggacaagtcgttgatttgaattgtaccggaaatgccaatgtcggcttggagacactggaattcatccatattcacaaaactgctgcacttttggaagcttctgtggtattgggtgctatattgggcggtggctctgacagcgaagtcgagaaattgagaacattcgccagaaaaataggtctattgttccaagttgtagacgacattctagacgtcaccaaatcttcggaagagctcggcaagactgctggtaaggatctaaccgttgacaaaactacgtatcctaaattactgggtttagagaaggcagttgaattcgcagaaaagcttaacgaagaggcgaaggcacaactagctgaatttgaaccctgtaaggccgcaccgttggcagctttagcagactatatagcccataggcaaaac

SEQ ID NO: 913 - DNA, 819 bp, Nepeta cataria
atgaaccagtcatattgggcagctatagaggcggatatagggacataccttaagaaatcgatacctatccgtcctcccgaaaccgtctttgagccaatgcaccatttgactttcgccgcaccaaccaccgccgcctctgccttatgcgtggcagcatgcgaactgactggaggcgaccgctcacaagcattggttgcagcatctgccattcacttagtacatgcagctgcctatgctcatgaacacttaccattaactgataggccaagacctgaatctaagccagaaatccatcataaatactcccctaatatcgagttgttaactccagatggtatggtacctttcgggtttgagcttctagcgaggagcatggatcctgccagggatggcgatccagacaggattctacgagtcattatagagatttcaagagctggtggctccgaaggtatgattgacgggctatatcgtgaagaagaaatagcagatctaaactacccaaggcctgatttcattgagtatgtgtgtaaaaaaaaatacggcgaacttcatgcttgtggggccgcatgtggggcaattttggccggagctgctgaggaagaagtcgagaaactaagaaattttggtagatacgccggtacattaattggtattatggggaataagtataatgttccggaaattgggaatatcatctcaaaactgagagagtttgcaatggaagagcttgaaaaaggatttcatggaaaaaatattgaactgatctcgagcctagtggcggagccatcacaagtggccgagagcctatcagcggcg

SEQ ID NO: 914 - DNA, 1071 bp, Streptomyces aculeolatus
atgaccactgaagtaacttctttcacaggcgccggaccacacccagcagcctctgtacgcagaataacagatgacttgttacaaagggtcgaggataagttagcgtcatttttaaccgctgaaagggaccgttacgccgcgatggatgagcgagctttggcagccgttgatgcactgactgatctagtaacgagtggcggtaaaagagtgcgccctacattctgtattactggttatctagctgcagggggcgatgccggggaccctgggattgttgcagcagctgccggtcttgaaatgttgcacgtttctgcacttatccatgacgatatattagacaactcggctcaaagacgaggcaaacccacgattcatactctatatggcgatttgcatgattcgcatggttggaggggtgaatctaggcgattcggagagggtattggcattctgattggaaacttggcgctagtttattcacaggaacttgtttgccaggctcctccggctgttctggctgaatggcatagattatgtagtgaagttaacattggtcaatgtctggatgtgtgtgctgcggctgaattcagcgccgacccagaattaagtaggttggtagcactgataaaaagtggtagatacacaatccataggccattggtgatgggagcaaatgctgccagcagacctgacttggctgcagcttacgttgaatacggtgaagccgtcggcgaagcttttcaactgagagacgacctattggatgcattcggggactcaactgaaacgggtaaacctactggcttagacttcactcaacataagatgactttattgttaggatgggctatgcaaagagatactcatattagaacactgatgactgaaccaggtcacacaccggaagaagttaggcgtagattagaagacactgaggtacctaaagatgtggaaagacatattgctgatttggtggaacaaggaagagccgccattgctgacgcccctatcgaccctcagtggagacaggaacttgctgacatggctgttagagcagcatacaggacaaat

SEQ ID NO: 915 - DNA, 1056 bp, Streptomyces sp.
atgactactgacactggccaagacgccgtcggtttggccagacggacgggggctgatctgttgcatagagtagaggaccgcctacgttcattgttggcagtagaaagagatgcctgggcagcggtgcacgaacaagctgtcgtcccagttgatgctttgagtgagttaatcgcgagcggaggcaaacgtattcgccctgctttttgcataactggatacttagctgctggtggagaccctgcagaacctggtatagttgccgcaggtgccgcccttgagatgttacatctatctgcacttgtgcacgatgatgttctagacgattcatcatcaagaaggggagtaccaacagttcatacgcaagcaatggccttgcatgagtcttcgggttggcaaggtgaacctagacgttatggagagggagtcgctatcttggtgggtgatttagcattagtatactcagaagagttaatggctgaggccccaagaagagttctacctgaatggaacaagctaagatctgaagtaatgataggacaatatatggacgttcatgctgctgccgaattttccgtcgatccacgatcttcacggttgatcgctcgaattaaatccggacgctataccatacacaggccattggttgttggcgctaagagaggccgaggtagaggtgatctagcaccagctttagaagaatacggcgaggctgtaggtgaagcattccaattgagagacgacttattagatgcatcggcaactcccgcggaaactggcaaacctacgggcttggattttactcagcacaaaatgacattgttattaggatgggcgatgcaaagagacgagcatatacatactttggttacggaacccggacatacgcccgacgaagttagaagaagattactggacactggagtacctgccgacgtggaaagacatattgcaggcttggtggaaagaggttgtaaagctatcgcagatgcacccgtggatcaagtgtggaggggagaattagctgctatggccggacgagtcgcctaccgtaccgct

SEQ ID NO: 916 - DNA, 1056 bp, Streptomyces cinnamonensis
atggcatgtattggaacggatcaagaattaaccgcgttagcaagaagaacgagagaagaattactggaacagatggaggacaggcttagggcttttcttagagctgaacatgaactttgggcagaggttaacgaaagagcagtcggtgctgtggctgctttgactgatttggtggcagcgggaggtaaaagaatcagaccagctttttgtattgcgggttatctagctgcgggtggcgatccagatgatacagcggtcgtagctgccgccgctgctttggaaatgttacatgcctctgctctaattcatgatgatgtgattgatgccagcagtcatagacgcggaagaccaaccgtacatgcgaggcattcagctctccatgatcgtaacgcatggcaaggagaatcgaggagatatggtgaaggtgttgctattctggtcggagatttagcattagtttattcggaacagttgatggcggctgctccgcctgctgttctcccggtatggggtactttaagatctgaattgatgattggacagtacatggacatgacagctgcagctgagttcttagttgatcctagacttagtcggtggatagcccttgcaaagagtggtcattacactattcatcgtcctttggttgtaggcgcaagtgccgccggaagagcggacctggcaccagctttcgccaagtacggtgaagccgtcggggaagcatttcaactccgtgacgacctgttggacgcattcggtgattttgctcatactggaaaaccagcaggattagattttagtcagcataagatgactctattactaagctgggcaatgcaaagagatgctagaattcattcattgataactgagcctggtcatacccccgatgaagttcgtaggagattagtagacacgggcgtgccagatgatgtggagaaacatatagctggtttggtggaacaaggttgtgaagccatagctgacgtgcctatcgatcctgtttggcggacagaactgactactatggctacccaagctgcatatagaaccacg

SEQ ID NO: 917 - DNA, 1053 bp, Streptomyces longwoodensis
atgacacgtagagctgctacagaccaagctactagtgcgagacgtacggttgaagacttacttcagcgagttcaacataggttaacaagtttcttggccgcagaaagggcgcactacgccgaagtgcatgagcatgccgtggtggcaatagatgccctagccgatctagccgctgcgggtggtaagttgctcagaccagcattttgcttgacgggatatttggcagcaggaggagacccagccgagcctggtattgtcgatgcagcagctgcactggagttgcttcatatttccgcactagtacatgatgatgtgttggacgattctagaactagaagaggtaagccagcagttcatgtcttacataccactctacatcggactagagggtggcaaggtgaatctcgaaggtttggagagggagttgccttattggtcggtgatttggcactagtatattccgacgagttgatggctggggcgccgcgtggtgcctttgccgaatggcatcggttaagaagtgaagtgatgattggtcaatatatggatgttgctgctgctgcagaattttcagttgatccagatttgtctaggctgatcgccttaatcaagagcggtaggtataccattcacagaccgttagtcttaggtgccagtgctgccggtcggaccgatcttgctggtgcactggcacattatggtgaggctgtcggagaagcattccagttaagagatgacctattagatgcatttggagacgcagctcgtaccggtaaaactgctggtttagatttttctcaacacaagatgacactactcttaggctgggcaatgcaaagggattcaagaattcatgatttaatcaccgaaccaggacatacacctgatgagatacgtgcaagactacttgatacaggtgtgccagcagacgtcgagcaacatatagcacatctagtcgaccaaggttgtgcggctcttgctgacgctcctctagagccacaatggagagcacagttaactgacatggcgttgagggtagcttatagagacaag

SEQ ID NO: 918 - DNA, 1056 bp, Streptomyces sp.
atgcctcaaaatgtacgaggtgaggaatcagctgctgctgctagaaggactgtagaagagttattgcaacgtgtacaagatagactctcaggcttccttgctgcagaacgggcgcgatacgccgaagttgatgagagggccgtggtagcaatagacgctctgagtgacttagtcgaagcagggggtaaattggttcggccggctttttgtttagcaggatatttggccgccggaggcgatccagaagcacctggtatcatagatgctgctgctgctttggaaatgttgcacatcagtgctctagtgcacgatgatgttttagacgattcgaggacacgcaggggaaaaccagcagtgcatgttttacactccagtttacacagaagtagagggtggcaaggggaagcgcgtcgattcggtgagggagtggctcttctcgtcggtgatttggcattggtatatagtgatgaacttatgtcacatgctccggcaactgctggccctgaatggcatcgcttgcggtctgaagtgatgattggtcaatacatggacgttgcagccgcggctgaattttcagtggatcctgcgttgagtcgtcttattgccctaatcaagtctggcagatacacaattcatagacctttagtggtaggcgcatctgctgctggcagggccgacctagcaccagcgttggcagaatatggtgaagctgttggagaagcattccaattgcgtgatgatctactagatgcgtttggcgatgcggctcaaacggggaagacagccggcttagacttctcccaacacaaaatgacattattgttgggttgggcaatgcagcgagacgcacacattcacggacttatcacagaaccaggtcacacaccggacgaagttagagctagattgttggacacaggagtaccagaggaagtggaacgccatattgcggccctagtcgatcaaggttgtgcggcaattgcagacgctcccgttggcccgcagtggagatcagaattgactaacatggctctaagggttgcatataggaataaa

SEQ ID NO: 919 - DNA, 1071 bp, Streptomyces sp.
atgccagtcacctctgatgcaactcgtgacacaggtcaggaagcagtatctcacgccagaagaattacaacagatcttctaagaagggttgaggatcgtttgtcatctttgttggccgcagagcgtgaggtatgggcagaagttcatgagggagctgtggtcccagtggatgcacttgctgagttgatggcaagcggaggtaaacgcatccgccctgcattttgcgtaacaggttacttagctgcaggtggtgatcctgatgccccaggaatagtcgctgctggtgctgcgttggagatgttacacattagtgctttagtccacgatgatgtgctggatgattcttcgagacggcgaggtttacctacagttcatactaagcatgcagccttacacgattcaagaggttggcagggtgaatcacgccggtacggtgaaggtgtggcagtactggtaggagacttagcactagtatactcagacgcgttaatgaccgaagcacctagacaggtcttacctgagtggaatcgattgagaagcgaagttatgataggtcaatacctggatgtccatgctgccgccgaattctctgcttctccgcgctcggctcggttgatagcaagaattaaatcaggcagatataccatacaccgtccattagtagttggtgctaaggcagctgggcgtgatgagttagcgccagtctttgaggaatatggtgaagcagtaggtgaggctttccaattaagagacgaccttctggacgctttcggtgatagtaccgacacgggtaagccaacaggactagacttcacccaacacaagatgacactcttactgggttgggcaatgcagagagatgaaagagtccatggtttgattaccgaaccaggtcatacccctggggaggtaagaagacgattggtcgatactggagttcctgcagacgtagaaagacatatcgcaggcttagtggaaagaggctgtaaggctatcgcagatgctcctatagatcaagtttggaggggtgaactggcagatatggctagacgtgcagcttacaggtctgca

SEQ ID NO: 920 - DNA, 1236 bp, Streptomyces aculeolatus
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagaccactgaagtaacttctttcacaggcgccggaccacacccagcagcctctgtacgcagaataacagatgacttgttacaaagggtcgaggataagttagcgtcatttttaaccgctgaaagggaccgttacgccgcgatggatgagcgagctttggcagccgttgatgcactgactgatctagtaacgagtggcggtaaaagagtgcgccctacattctgtattactggttatctagctgcagggggcgatgccggggaccctgggattgttgcagcagctgccggtcttgaaatgttgcacgtttctgcacttatccatgacgatatattagacaactcggctcaaagacgaggcaaacccacgattcatactctatatggcgatttgcatgattcgcatggttggaggggtgaatctaggcgattcggagagggtattggcattctgattggaaacttggcgctagtttattcacaggaacttgtttgccaggctcctccggctgttctggctgaatggcatagattatgtagtgaagttaacattggtcaatgtctggatgtgtgtgctgcggctgaattcagcgccgacccagaattaagtaggttggtagcactgataaaaagtggtagatacacaatccataggccattggtgatgggagcaaatgctgccagcagacctgacttggctgcagcttacgttgaatacggtgaagccgtcggcgaagcttttcaactgagagacgacctattggatgcattcggggactcaactgaaacgggtaaacctactggcttagacttcactcaacataagatgactttattgttaggatgggctatgcaaagagatactcatattagaacactgatgactgaaccaggtcacacaccggaagaagttaggcgtagattagaagacactgaggtacctaaagatgtggaaagacatattgctgatttggtggaacaaggaagagccgccattgctgacgcccctatcgaccctcagtggagacaggaacttgctgacatggctgttagagcagcatacaggacaaat

SEQ ID NO: 921 - DNA, 1221 bp, Streptomyces sp.
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagactactgacactggccaagacgccgtcggtttggccagacggacgggggctgatctgttgcatagagtagaggaccgcctacgttcattgttggcagtagaaagagatgcctgggcagcggtgcacgaacaagctgtcgtcccagttgatgctttgagtgagttaatcgcgagcggaggcaaacgtattcgccctgctttttgcataactggatacttagctgctggtggagaccctgcagaacctggtatagttgccgcaggtgccgcccttgagatgttacatctatctgcacttgtgcacgatgatgttctagacgattcatcatcaagaaggggagtaccaacagttcatacgcaagcaatggccttgcatgagtcttcgggttggcaaggtgaacctagacgttatggagagggagtcgctatcttggtgggtgatttagcattagtatactcagaagagttaatggctgaggccccaagaagagttctacctgaatggaacaagctaagatctgaagtaatgataggacaatatatggacgttcatgctgctgccgaattttccgtcgatccacgatcttcacggttgatcgctcgaattaaatccggacgctataccatacacaggccattggttgttggcgctaagagaggccgaggtagaggtgatctagcaccagctttagaagaatacggcgaggctgtaggtgaagcattccaattgagagacgacttattagatgcatcggcaactcccgcggaaactggcaaacctacgggcttggattttactcagcacaaaatgacattgttattaggatgggcgatgcaaagagacgagcatatacatactttggttacggaacccggacatacgcccgacgaagttagaagaagattactggacactggagtacctgccgacgtggaaagacatattgcaggcttggtggaaagaggttgtaaagctatcgcagatgcacccgtggatcaagtgtggaggggagaattagctgctatggccggacgagtcgcctaccgtaccgct

SEQ ID NO: 922 - DNA, 1221 bp, Streptomyces cinnamonensis
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggaggcatgtattggaacggatcaagaattaaccgcgttagcaagaagaacgagagaagaattactggaacagatggaggacaggcttagggcttttcttagagctgaacatgaactttgggcagaggttaacgaaagagcagtcggtgctgtggctgctttgactgatttggtggcagcgggaggtaaaagaatcagaccagctttttgtattgcgggttatctagctgcgggtggcgatccagatgatacagcggtcgtagctgccgccgctgctttggaaatgttacatgcctctgctctaattcatgatgatgtgattgatgccagcagtcatagacgcggaagaccaaccgtacatgcgaggcattcagctctccatgatcgtaacgcatggcaaggagaatcgaggagatatggtgaaggtgttgctattctggtcggagatttagcattagtttattcggaacagttgatggcggctgctccgcctgctgttctcccggtatggggtactttaagatctgaattgatgattggacagtacatggacatgacagctgcagctgagttcttagttgatcctagacttagtcggtggatagcccttgcaaagagtggtcattacactattcatcgtcctttggttgtaggcgcaagtgccgccggaagagcggacctggcaccagctttcgccaagtacggtgaagccgtcggggaagcatttcaactccgtgacgacctgttggacgcattcggtgattttgctcatactggaaaaccagcaggattagattttagtcagcataagatgactctattactaagctgggcaatgcaaagagatgctagaattcattcattgataactgagcctggtcatacccccgatgaagttcgtaggagattagtagacacgggcgtgccagatgatgtggagaaacatatagctggtttggtggaacaaggttgtgaagccatagctgacgtgcctatcgatcctgtttggcggacagaactgactactatggctacccaagctgcatatagaaccacg

SEQ ID NO: 923 - DNA, 1218 bp, Streptomyces longwoodensis
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagacacgtagagctgctacagaccaagctactagtgcgagacgtacggttgaagacttacttcagcgagttcaacataggttaacaagtttcttggccgcagaaagggcgcactacgccgaagtgcatgagcatgccgtggtggcaatagatgccctagccgatctagccgctgcgggtggtaagttgctcagaccagcattttgcttgacgggatatttggcagcaggaggagacccagccgagcctggtattgtcgatgcagcagctgcactggagttgcttcatatttccgcactagtacatgatgatgtgttggacgattctagaactagaagaggtaagccagcagttcatgtcttacataccactctacatcggactagagggtggcaaggtgaatctcgaaggtttggagagggagttgccttattggtcggtgatttggcactagtatattccgacgagttgatggctggggcgccgcgtggtgcctttgccgaatggcatcggttaagaagtgaagtgatgattggtcaatatatggatgttgctgctgctgcagaattttcagttgatccagatttgtctaggctgatcgccttaatcaagagcggtaggtataccattcacagaccgttagtcttaggtgccagtgctgccggtcggaccgatcttgctggtgcactggcacattatggtgaggctgtcggagaagcattccagttaagagatgacctattagatgcatttggagacgcagctcgtaccggtaaaactgctggtttagatttttctcaacacaagatgacactactcttaggctgggcaatgcaaagggattcaagaattcatgatttaatcaccgaaccaggacatacacctgatgagatacgtgcaagactacttgatacaggtgtgccagcagacgtcgagcaacatatagcacatctagtcgaccaaggttgtgcggctcttgctgacgctcctctagagccacaatggagagcacagttaactgacatggcgttgagggtagcttatagagacaag

SEQ ID NO: 924 - DNA, 1221 bp, Streptomyces sp.
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagcctcaaaatgtacgaggtgaggaatcagctgctgctgctagaaggactgtagaagagttattgcaacgtgtacaagatagactctcaggcttccttgctgcagaacgggcgcgatacgccgaagttgatgagagggccgtggtagcaatagacgctctgagtgacttagtcgaagcagggggtaaattggttcggccggctttttgtttagcaggatatttggccgccggaggcgatccagaagcacctggtatcatagatgctgctgctgctttggaaatgttgcacatcagtgctctagtgcacgatgatgttttagacgattcgaggacacgcaggggaaaaccagcagtgcatgttttacactccagtttacacagaagtagagggtggcaaggggaagcgcgtcgattcggtgagggagtggctcttctcgtcggtgatttggcattggtatatagtgatgaacttatgtcacatgctccggcaactgctggccctgaatggcatcgcttgcggtctgaagtgatgattggtcaatacatggacgttgcagccgcggctgaattttcagtggatcctgcgttgagtcgtcttattgccctaatcaagtctggcagatacacaattcatagacctttagtggtaggcgcatctgctgctggcagggccgacctagcaccagcgttggcagaatatggtgaagctgttggagaagcattccaattgcgtgatgatctactagatgcgtttggcgatgcggctcaaacggggaagacagccggcttagacttctcccaacacaaaatgacattattgttgggttgggcaatgcagcgagacgcacacattcacggacttatcacagaaccaggtcacacaccggacgaagttagagctagattgttggacacaggagtaccagaggaagtggaacgccatattgcggccctagtcgatcaaggttgtgcggcaattgcagacgctcccgttggcccgcagtggagatcagaattgactaacatggctctaagggttgcatataggaataaa

SEQ ID NO: 925 - DNA, 1236 bp, Streptomyces sp.
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagccagtcacctctgatgcaactcgtgacacaggtcaggaagcagtatctcacgccagaagaattacaacagatcttctaagaagggttgaggatcgtttgtcatctttgttggccgcagagcgtgaggtatgggcagaagttcatgagggagctgtggtcccagtggatgcacttgctgagttgatggcaagcggaggtaaacgcatccgccctgcattttgcgtaacaggttacttagctgcaggtggtgatcctgatgccccaggaatagtcgctgctggtgctgcgttggagatgttacacattagtgctttagtccacgatgatgtgctggatgattcttcgagacggcgaggtttacctacagttcatactaagcatgcagccttacacgattcaagaggttggcagggtgaatcacgccggtacggtgaaggtgtggcagtactggtaggagacttagcactagtatactcagacgcgttaatgaccgaagcacctagacaggtcttacctgagtggaatcgattgagaagcgaagttatgataggtcaatacctggatgtccatgctgccgccgaattctctgcttctccgcgctcggctcggttgatagcaagaattaaatcaggcagatataccatacaccgtccattagtagttggtgctaaggcagctgggcgtgatgagttagcgccagtctttgaggaatatggtgaagcagtaggtgaggctttccaattaagagacgaccttctggacgctttcggtgatagtaccgacacgggtaagccaacaggactagacttcacccaacacaagatgacactcttactgggttgggcaatgcagagagatgaaagagtccatggtttgattaccgaaccaggtcatacccctggggaggtaagaagacgattggtcgatactggagttcctgcagacgtagaaagacatatcgcaggcttagtggaaagaggctgtaaggctatcgcagatgctcctatagatcaagtttggaggggtgaactggcagatatggctagacgtgcagcttacaggtctgca

SEQ ID NO: 926 - DNA, 1047 bp, Penicillium aethiopicum
atggcaaccagcacgacaacttctttaaaggaatttttgtcagttttcccacagcttgtggccgatttgcgtgcattatgtttggaggaataccaactaccagcttgcgtttgggacagatttgaatcaacattgaaccataatacattaggtggtaagtgtaatagaggcttgtctgtcatcgacagtgtcagattattgagagatggtttagagttgagtccagcagaatatttcgatgccgcggtattaggttggctcgtggaactattgcaagcaactatgttagttttagacgacattatggacggcagtccaaccagaaggggtaagccctcttggtacagagtgcccggtgtcggtatggcagcagttaatgatgccaccatgttggagagcgctatttacatgctattaaagaaatattttgccgggagggcgatatatttgcctgttgttgacttatttcatgaaacagcactgcagatcgagttaggtcaagctttcgacatgttaatagctaatgaggggaccccagatctcacaactttcgtacccgctacttatagtcagattgtaacctataaaaccgcgttttattcgttctatcttcctgtggccctggctttacacgctgttgatgcggcaacacctacaaatctggccgccgcaagggcaatattggtaccaatgggtgagtattttcaggtccaagacgactacctagactgctttgcagatccaacggttctagggaaggttggcacagatattattgagggtaaatgttcttggttggtggttcaggcactacagagagcatcaaccgatcaagctcaattgctggctgaaaattatgggtccgcctctggtgagtcctccgtgaaagcactatattcagaactggatttagaaagtgtctataggacatttgaagagcagagagttgcggaattgagaaccttgattacgggactggacgaatcgcaagggttaaggaaatctgtctttgaggaactgcttggtaaaatttatcaaagacgtaaa

SEQ ID NO: 927 - DNA, 1212 bp, Penicillium aethiopicum
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggaggcaaccagcacgacaacttctttaaaggaatttttgtcagttttcccacagcttgtggccgatttgcgtgcattatgtttggaggaataccaactaccagcttgcgtttgggacagatttgaatcaacattgaaccataatacattaggtggtaagtgtaatagaggcttgtctgtcatcgacagtgtcagattattgagagatggtttagagttgagtccagcagaatatttcgatgccgcggtattaggttggctcgtggaactattgcaagcaactatgttagttttagacgacattatggacggcagtccaaccagaaggggtaagccctcttggtacagagtgcccggtgtcggtatggcagcagttaatgatgccaccatgttggagagcgctatttacatgctattaaagaaatattttgccgggagggcgatatatttgcctgttgttgacttatttcatgaaacagcactgcagatcgagttaggtcaagctttcgacatgttaatagctaatgaggggaccccagatctcacaactttcgtacccgctacttatagtcagattgtaacctataaaaccgcgttttattcgttctatcttcctgtggccctggctttacacgctgttgatgcggcaacacctacaaatctggccgccgcaagggcaatattggtaccaatgggtgagtattttcaggtccaagacgactacctagactgctttgcagatccaacggttctagggaaggttggcacagatattattgagggtaaatgttcttggttggtggttcaggcactacagagagcatcaaccgatcaagctcaattgctggctgaaaattatgggtccgcctctggtgagtcctccgtgaaagcactatattcagaactggatttagaaagtgtctataggacatttgaagagcagagagttgcggaattgagaaccttgattacgggactggacgaatcgcaagggttaaggaaatctgtctttgaggaactgcttggtaaaatttatcaaagacgtaaa

SEQ ID NO: 928 - DNA, 1080 bp, Ocimum basilicum
atggcaaagtcgcccgagaccgagcacccggttaaggccctcggttgggctgctaccgataactctggaaccttctctcctttcaacttttcgagacgtgctaccggcgagcgcgatgtacaatttagagtcctgtactgtggagtgtgccacagtgatctgcatatggtgaagaacgaatggggtgttacccattaccctattgtgcctggacacgagatcgtcggtatcgtgactgaggtcggttccaaggtggagaaggtgaagatcggagacaaggtgggtgtgggcgtcctggttggatcctgtcgacaatgtgaccagtgttcaaatgacctggagaattactgttacaaacagattctgacatacggagcgccctatcttgacggcacgatcgcccgtgggggatactcggacattatggtcgcagacgagcatttcatcattcgctggcccgagaactttccgcttgatgctggcgccccgctcctttgtgccggtatcactacgtacagccccctgaagtacttcggcctggataagcccggactccgagtgggcgtgaatggccttggaggcctgggtcacgttgctgtcaagtttgctaaggccttcggaaccaaggttactgtgatcagtacctctctttccaagaaggaggaggctatgcagcacctgggtgtggacgagtttgttgtctcaaccgatccccagcagatgcaggcagctgtgggcactttggacggcatcatcgacacggtttctgcaccgcatcccatcgtccctctgctgtcactcttgaagcctcacggcaagctaattgttgtgggcttgccggataagcccctgcagctgccagtgttcccactcatccagggccgacgcacgatcgctggatctggtattggcggactgaaggagacccaggagatgattgattttgctgcaaagaataacatcgtcgctgatgtggaggtcatccccatcgactacatcaacacggctatggatagactgctgaagtccgatgtcaagtaccgcttcgtcatcgatgtggagaagtcgctcaagccccag

SEQ ID NO: 929 - DNA, 1641 bp, Catharanthus roseus
atgtcctctagctctagctcatcatcaagtatgtctctgccactggcgacacccttgataaaggacaacgagagcctaatcaagttcctaagacaacctctggttctgccgcacgaagtcgatgactcaacaaaaaggagagagctgttggagagaactaggaaggaactggaactgaatgcggagaagcccctagaagcgttgaaaatgatcgacattatccaaagactaggtctttcctatcatttcgaggacgatatcaactctattttgaccggcttttccaacattagtagccagacccatgaagacttattaacggcatccctatgcttcaggttattgaggcacaatgggcataaaattaacccggatattttccaaaaatttatggacaataacggtaaattcaaagattccctaaaagatgacaccctagggatgctgagcttgtatgaggcgtcatatttaggcgccaacggagaggaaattctaatggaagcgcaagagttcacgaagacacacctgaagaattccctacctgccatggcacctagcttgtcaaagaaggtgtcacaagcattggagcaaccgagacacagaagaatgctgagattagaagcaagaaggttcattgaagaatacggcgcagagaacgaccacaatccagacttgttagaactagcaaaacttgattataacaaggttcagtccttacatcagatggaattgtctgagataactcgttggtggaagcagctaggtttggtggataagctgacgttcgctcgtgacaggccgttagagtgtttcttgtggacggtggggcttttgccggaaccgaaatacagtgggtgtagaatagagctagctaagaccattgctatcctgctagttatagacgatatatttgacactcatgggaccttagatgagttgctattgttcactaatgcgatcaaaaggtgggatttagaggcaatggaggatctgcctgagtatatgcgtatatgctacatggctttgtacaatactacaaacgaaatttgctacaaggtcttaaaagagaatggctggagcgtgcttccatacttaaaagcgacgtggatagatatgatagaagggtttatggttgaggcggaatggtttaattcagattacgtaccaaacatggaggagtatgttgaaaacggtgttagaaccgcggggagttatatggctttagtacatttgtttttcctgataggccagggtgtcacggaagataacgtaaaattgcttataaaaccctatcctaaacttttttcctcatccggccgtatacttagattgtgggatgatctgggcacagcgaaggaggaacaagaaagaggtgacttagcgagttctattcagctttttatgagggaaaaagaaattaagtcagaagaagagggtagaaaggggatccttgagattatcgagaacctgtggaaagagttaaatggggagttggtttaccgtgaagaaatgccacttgccattatcaagactgcatttaacatggcgcgtgcatcacaggttgtctaccagcacgaagaagacacctacttctctagtgtcgataactacgtcaaggctcttttcttcactccctgtttc

SEQ ID NO: 930 - DNA, 1515 bp, Ocimum basilicum
atgcagcatatggaagaatcaagcagcaagagaagagagtatcttctagaagagacaactaggaagttacagcgtaacgataccgagagcgttgagaaattgaaattaatcgataacatacagcaattaggcataggctactatttcgaagacgcaattaatgcggtattaaggagtccctttagtactggtgaggaagaccttttcacagccgctctgcgttttaggcttcttaggcataacggtatagagattagtcccgaaattttcttgaaatttaaagatgaaagaggtaagtttgacgaatctgacacacttggattactgtccctgtatgaggcaagcaatttgggcgttgctggcgaggaaattttagaggaggcgatggaatttgccgaggcaaggctacgtcgttcattatcagaaccagccgcccccttacacggtgaagtggcccaagccttagacgtaccgaggcacctgaggatggccagactagaagcacgtaggtttattgaacagtacggaaagcagtccgaccatgacggggacttactggagttagctatcctggattacaaccaagtgcaggcacaacatcaaagtgagcttacggagattattagatggtggaaggaactgggcttggtagataaactaagctttggaagagatagaccccttgaatgcttcttatggactgtcggactgttacccgagcccaaatatagctccgttcgtatcgagttagcaaaggctatctccatcttacttgttatcgacgacatctttgacacgtatggtgaaatggatgatttaatactgttcactgatgccataaggagatgggatctagaggctatggagggattgccagaatacatgaaaatatgctatatggccctatataacacgactaatgaagtttgctacaaggttcttagggacacgggccgtatcgtgctgttaaacctgaaatcaacatggatcgatatgatcgaaggcttcatggaggaagcaaaatggtttaatggcggttctgcacccaagttagaggagtacatagagaatggtgtgagcacggctggcgcttatatggcgttcgctcacattttctttctaattggagagggagtcacccaccagaactctcagctatttacacagaagccctacccgaaagtattttctgctgccggtagaatattgagactttgggatgatttaggaactgcgaaggaagaacaggaaaggggcgacttggcctcatgtgtgcagctgtttatgaaggaaaaaagtttgacagaggaggaggcaagatcaagaatcttagaggagataaagggactttggagggaccttaatggcgaactggtttataataaaaatttaccactttctatcatcaaggttgccctgaatatggctcgtgcgtcccaagtggtctacaaacatgaccaggatacttactttagctccgtcgacaattacgtagatgcgctgttcttcacgcag

SEQ ID NO: 931 - DNA, 1521 bp, Valeriana officinalis
atgattatggaacttgtggaagcgactcgtaggaccttaaggaatgagtcatccgatagtaccgaaaagatgagactgattgactctttgcagaggcttgggttgaatcaccattttgagcaggatataaaggaaatgttgcaagactttgccaacgaacacaagaatacaaatcaggacctattcacgactagcctgcgttttaggctgttgagacataatggctttaatgttactccggacgttttcaataaatttacagaggaaaacggtaaatttaaggaatcactaggcgaggataccatcgggattctgtcactatacgaggcaagctatttagggggtaaaggtgaggagatactaagcgaggccatgaagttctccgaatccaagctgagggagtcaagtggtcacgtcgctccccacattcgtagacagatttttcaatccttggagctgccacgtcacctgagaatggctaggttggaatccaggcgttacatagaggaggattactcaaatgagatcggggctgatagctccttactggagctagctaagttagacttcaacagcgtccaagccctacatcagatggaattaacagagatctcaaggtggtggaaacaacttgggctgtcagacaaattgcccttcgcaagagatcgtccgctggaatgttttctgtggaccgtcggattgctaccagagccaaaatattccggatgtcgtattgagttggctaaaacaatagcggtattattggtgatagacgatatttttgatacctacggatcatacgaccagctaatattgtttacgaacgccattagacgttgggatttggacgcaatggacgagttgccggagtacatgaagatatgttatatggcattatacaatactaccaacgagatttgctacaaagtacttaaagaaaacgggtggtcagtccttccctacttagagcgtacttggattgacatggtagaggggttcatgttggaagccaaatggcttaatagcggggaacagccaaatttggaggcttacatagagaacggggtgacaaccgcggggtcttatatggcgcttgtgcatctgttcttcttaattggggatggcgtgaacgatgaaaacgtaaaactgctactagatccttatccaaaacttttttctagtgccgggcgtatccttagactttgggatgacctgggcaccgccaaagaagaacaggaaagaggagacgtttcatcatccatacaactttacatgaaagaaaaaaatgtacgtagtgagagcgaagggagagagggcatcgtagagataatctataacctttggaaagacatgaacggcgaactaatcgggtccaacgcgctaccccaagcaataatagaaacaagctttaacatggcgaggactagccaggtggtctatcaacacgaggacgacacatatttctcctcagttgacaattacgtccagagtctgttcttcaccccagttagcgtgtccgtg

SEQ ID NO: 932 - DNA, 1641 bp, Catharanthus roseus
atgagctcctcatcctcttcaagctcatcaatgagcctaccactagctactcctttaataaaggacaatgaatcattgattaagttcctacgccaaccacttgtattaccacatgaggttgacgattctacaaagcgtagagaattactagagcgtacaagaaaagaacttgaattaaacgctgaaaagcctctagaagctcttaaaatgatagatattattcagcgcttgggattatcatatcattttgaagatgatattaattctattctaaccggtttttcaaatatctcaagtcaaacacacgaagacttattgactgcttctttgtgcttcagattgctccgtcacaacggtcataaaataaatccagatattttccaaaagttcatggataataatggtaaattcaaagactctctaaaggatgatacgttgggtatgttatcactgtatgaagcctcttacttgggagctaatggcgaagaaattctaatggaagcacaagaattcacgaagactcatctgaagaacagtctacctgcaatggcaccttctctaagtaaaaaggtgtcacaagctcttgagcagcctagacacagacgaatgttgagattagaagctagacggttcatagaagaatacggtgccgaaaatgatcataatcctgatttgctagaattggcgaaattggattataataaggtgcaatccttacatcaaatggaactctctgagattacaagatggtggaaacaattgggcctagttgataaattaactttcgccagagacagacccttagagtgttttttgtggactgttggcttattacctgaaccaaaatacagcggatgtaggattgaattagctaagacaatcgctatcttattggtaatagacgacatttttgatactcacggtaccttagatgaacttctattatttactaacgccataaagagatgggatttagaagctatggaagacttacctgagtatatgcgtatctgttatatggctctttataacaccactaatgagatttgctataaagtcctgaaggagaatggatggtcagtattaccatatttgaaggccacatggatagacatgatcgagggttttatggtcgaggctgaatggtttaactccgactacgtgccaaacatggaagagtatgtagaaaatggtgtgcgtactgcaggtagttacatggcgctggttcacttattttttttgattggacaaggggtaactgaagataatgtcaaattattgatcaaaccctacccaaaattatttagcagttccggaagaattttacgcctttgggatgatctcggtactgcaaaggaagaacaagaaagaggggacctcgcttcatctatccaattgtttatgagggaaaaagaaattaaaagtgaggaggaaggtcgaaaaggtattttagaaatcattgagaatctatggaaggaacttaatggggaactagtttatcgtgaagaaatgccgctggctataattaagactgcattcaatatggctagggcgtctcaagtagtctatcaacatgaagaagatacttatttttccagcgtagacaactacgttaaggcactattctttacaccgtgtttc

SEQ ID NO: 933 - DNA, 1515 bp, Ocimum basilicum
atgcaacacatggaagaatcttcctctaaaagaagggaatacttgttggaggaaactactcgcaaattacaaagaaatgatacagaatcagttgaaaaactaaaacttatagataacattcaacagttaggcattggctattatttcgaagatgcaattaacgccgtgttacgttcacctttctcaacaggagaagaggatttatttactgccgcattaagatttagactgttgagacacaatggtatcgaaataagccccgagatattcttaaaatttaaggatgaaagaggaaagttcgatgaatctgatacattgggccttctatctttgtatgaagcaagtaacctcggtgtagcaggggaggaaattttggaagaggctatggaattcgccgaagcgagattgagacgtagcttatctgaacccgctgctcctttacacggtgaggtcgctcaagcattggatgttcctcgacatctcaggatggccaggcttgaggctagaagatttatagaacagtatggtaagcaaagcgatcatgatggcgacttactggagttggctattttagactataatcaagtgcaagctcaacatcagtcagaactaaccgaaataattagatggtggaaagaattaggtttggttgacaagttgtctttcggtcgtgatagaccgctcgaatgttttttgtggactgttggtttgttaccagaacctaaatattcatccgttcgtatcgaactggcaaaagcgatttctatattgttagtaattgatgacatcttcgacacatacggtgagatggacgatcttattttgttcactgatgctattagacgctgggatttagaggccatggaaggtctacctgagtatatgaagatttgttacatggccctctacaatacaaccaatgaggtttgttataaagtcttacgtgacacgggtagaatagtcttgttaaatctcaaatctacatggatagacatgatcgagggttttatggaagaagctaagtggttcaatggagggagcgcacccaaacttgaggagtacattgaaaatggtgttagtactgctggggcgtacatggcctttgcccacattttttttttgattggtgaaggtgttacccatcagaattctcaacttttcacgcaaaaaccatatcctaaggtttttagcgcagctggtagaatattgcgtttatgggatgatttgggcacagctaaagaagaacaggagcgtggcgacttagcctcttgtgttcaactttttatgaaggaaaagtcgcttacagaggaagaagcgagatcgagaatactggaggaaatcaagggtttgtggagagacctaaacggggaattggtgtacaataaaaatttaccgttatcgattattaaggtggcgttgaacatggccagagcctcccaggtagtgtataaacacgaccaagatacctatttctcgtcggttgacaactatgtcgacgctttattctttacacaa

SEQ ID NO: 934 - DNA, 1521 bp, Valeriana officinalis
atgataatggaattggtggaagctactcgtagaacattgagaaatgaatctagtgacagtacagaaaaaatgagattaatagatagcctacagaggcttggcttgaatcatcattttgaacaagacattaaagaaatgctccaagattttgctaatgaacataagaatactaaccaagatttgtttactacttcgttgcgctttcgtttgcttagacataacggatttaacgtcacacctgatgtgttcaacaaatttactgaagaaaatggaaaatttaaggaatccttgggagaagatactattggtattctgagtctatacgaagcaagttatttgggtggtaagggggaagaaatactcagtgaagctatgaagtttagcgaaagcaaactacgtgaatcttctggtcacgtagccccacatattcgtaggcaaatattccaaagcctagaactccctagacatttacgaatggcacgacttgaatccaggaggtatattgaggaggattattcaaacgaaattggtgctgatagttctctgttagagttagcaaaattggattttaattccgttcaggcactgcaccaaatggaactgacagagatttccagatggtggaagcagttagggctgtccgacaaattgccttttgccagagacagaccactagaatgtttcttgtggactgtcggtttactaccagaaccaaaatattcaggttgtagaatcgaacttgcgaaaactattgcagttttattggtgatcgatgatatattcgacacctatggatcttacgatcagctcatattattcacgaacgcaattagaagatgggatttagatgccatggacgaacttccggagtacatgaagatatgctatatggctctgtacaacacaactaacgaaatatgctacaaagttttaaaggaaaatggttggtctgtattaccttacctcgagagaacatggatagacatggtagaaggatttatgcttgaagcaaaatggctaaactctggagagcaacctaatcttgaggcctacatcgaaaatggggtaacaacagccggctcatatatggcgctggtgcacctttttttcttgataggagatggcgttaatgacgagaacgttaagttgttgttagatccttaccctaagttgttcagctcagcaggaagaatcttgagattgtgggatgatttagggacagctaaggaagaacaagaaagaggagatgttagctcttccatccaattatacatgaaggaaaagaatgtgcggagtgagtcagaaggaagagagggtatcgtcgaaataatatacaatttatggaaagatatgaatggggaactcattggttctaacgccttacctcaagcgataatcgagacctcattcaacatggctagaacatctcaagtagtttatcaacatgaagatgatacttatttttcatctgtggataattatgtccaaagtttgttctttactccagtttccgttagtgtc

SEQ ID NO: 935 - DNA, 1641 bp, Catharanthus roseus
atgagttcgtcatctagttcatcatcgtcgatgtctcttcctttggccactccattgattaaggacaacgaatcattgattaagtttctacgtcaaccactagtgctcccacatgaagttgatgattccacaaaaagacgagaattacttgagaggaccaggaaagaattagaactgaatgctgaaaagccactagaagccttgaaaatgatcgatataatacagagacttggtctgagttaccacttcgaagatgacattaactctattttaaccggtttctctaacatctcgtcccaaacccacgaggatctgctaacagccagcctctgtttcagattactacgccataatgggcataaaattaaccctgacatatttcaaaaatttatggacaataacggtaaattcaaggactcgcttaaagatgataccttgggtatgttgtctctctatgaagcttcatatttaggagcaaatggtgaggaaatactaatggaagcccaagaatttacgaagacacatttaaagaattcattaccagctatggcaccatctttatcgaaaaaggtttcccaggccttggaacagccacgtcataggcgaatgttgaggctggaagcacggcgatttatagaagaatacggtgcggagaacgaccataatcccgatttgcttgagttagctaagttggattataataaggtgcaatctcttcatcaaatggaattatccgaaattactaggtggtggaaacaacttggactagttgataaattgacctttgcaagagaccgacccttagaatgtttcctgtggactgttggtttattgcccgagccaaagtattctggttgtaggatcgaactggcgaaaaccatcgccattctactagttattgacgacattttcgacacccacggtacattagatgaacttttgcttttcaccaatgctattaaacggtgggacctggaggctatggaagatttaccagaatatatgcgcatctgctatatggcattgtacaatacaaccaatgaaatatgctataaagtgttgaaagagaatggttggagtgtacttccctacctgaaagctacatggattgatatgatcgaaggctttatggttgaagccgagtggtttaactccgattacgtcccaaatatggaagagtacgttgagaatggtgtcagaacagcaggctcatacatggcgttagttcatctattctttctaatcggccaaggtgttacggaagataatgttaaactcttaattaaaccataccctaaattatttagctcatcaggtagaattctgagattgtgggatgacctaggcacggcaaaagaagaacaagaaaggggcgatttagcttcctctatccaactttttatgcgcgaaaaggaaatcaagtcagaagaggaaggtagaaaaggtatcttggaaattatagaaaacttgtggaaggagttaaatggtgagctggtctacagagaagaaatgccgttggccataataaagaccgctttcaatatggctcgagcttctcaggtagtttaccaacatgaagaggatacttatttctcgagtgttgacaactacgtcaaggccttgttttttactccctgcttt

SEQ ID NO: 936 - DNA, 1515 bp, Ocimum basilicum
atgcaacatatggaggaatcttcgtccaagagacgtgaataccttttggaagagacgacacgtaaactgcagcgtaatgatacagagagcgttgaaaaactcaagttaatagataacattcaacaattaggtattggatactacttcgaggacgcaataaacgcagttctgaggagtccgttctctactggagaggaagacctttttacagcagccttaaggttcagactactacggcataacggtattgaaatatctccagaaatatttcttaagttcaaggatgaacgtggtaaatttgacgagtctgacacactaggtcttctttcattatatgaagccagtaatttgggcgttgccggggaagaaatcttggaagaagcaatggaatttgcagaggctagactacgtaggtccctttcagaaccggctgcaccattgcatggtgaagtggctcaagctctcgatgtcccacgacatctaagaatggcaagattggaagcacgacgttttatcgaacaatacggtaaacaaagtgatcatgacggcgacctcttggaattagctatcttggactacaatcaggtccaagcccaacaccaatcagaactgacggaaattatacggtggtggaaggagctaggcttggttgacaagttatcatttggtagagataggcctctagaatgttttctatggacggtaggattactgccagaaccgaagtatagtagtgtgcgaatagagctggctaaagcgattagtattttactagttattgatgacattttcgatacatacggagaaatggatgatttaattttgtttactgatgcgattagaaggtgggatttagaagcaatggagggattgcctgaatatatgaaaatttgttacatggcactgtataataccacgaatgaagtctgctacaaagtgttaagagataccggtcgcattgttcttttgaacttaaaaagtacttggatagatatgatagagggctttatggaagaggctaagtggtttaacggaggatcggctcctaagttggaagaatacatagaaaatggagtgtctacagctggcgcttacatggcctttgcgcatatctttttcctaattggtgaaggagtcacacaccaaaactctcagctgttcactcagaaaccttatccaaaggtattttctgctgctgggagaatattgcgactttgggacgatttgggtacggctaaagaggaacaagagaggggtgatttggccagctgtgttcaactatttatgaaggaaaaatcgctaacagaagaagaagcccgttcaagaattctagaagaaattaaaggcttgtggcgtgacttgaatggtgaattagtatataataaaaatctacctttatctatcattaaggtagcgttaaatatggccagagcatcacaagttgtgtataaacatgatcaagatacatattttagttcagtggataattatgtagatgccttgttctttacacag

SEQ ID NO: 937 - DNA, 1707 bp, Perilla citriodora
atgtcttctaaagcggcctcctgcttgcgagcctcttgtagtttgcaattggatgtcaaaccggttcaggaaggtcgtaggtctgggaattaccaaccaagcatatgggattttaattacgtccaatcgttgaacactccatataaagaagaaagatatttaaccagacatgctgaattaatagttcaggtcaaaccattactcgaaaaaaaaatggaacctgcacaacaattggaacttattgacgatctcaataatttaggtctaagttatttctttcaagatagaataaaacaaattctttcgttcatttacgatgaaaaccaatgtttccacagtaacatcaacgatcaagctgaaaaaagagacttgtacttcactgcactgggttttagactgcttagacaacacggttttgatgtttctcaagaagtgttcgactgttttaaaaatgacaacggttccgattttaaagctagcctttccgataatacgaaaggtctacttcagttatacgaggcttctttcttagtgcgtgaaggtgaagatacattggaacaagcccgtcaatttgcaacgaaatttctaagaagaaagctggatgagatagatgataaccatttactgtcttgtatacatcacagtttagaaattccactccactggagaatccaaaggttggaagcccgctggttcctggatgcttatgctacacgccatgacatgaatcccgtaatattggaattagcgaagctggactttaacattattcaagccacgcatcaagaggaattgaaagatgtcagcagatggtggcaaaacactaggctagccgaaaagttgcctttcgtcagagatagattagtcgaatcttacttttgggctattgccttattcgaaccacaccagtacggctatcagagaagagttgctgcgaaaataattacgttggcaactagtatagatgatgtgtatgatatttacggaactttagatgaattacaactttttaccgacaactttcgtagatgggatacggagtccctagggcgccttccttactcaatgcaactgttttatatggttatccataattttgtgtccgaactcgcttatgagatcctgaaggaaaagggttttatcgtcataccatatttgcaaagatcctgggtagatctagctgagtcttttcttaaagaagctaattggtattattccggttatacgcccagtttggaggaatatattgataatggctcaatatctattggcgccgtggcagttttgtctcaagtgtacttcactcttgcgaattctatagaaaagcccaaaatcgaatccatgtataagtatcaccatatcttgagattgtccggcctgttggtaaggttacatgacgacttaggtacgtctctcttcgaaaaaaaacgtggcgatgttcccaaggcggttgaaatctgcatgaaggaaagaaatgttacagaagaagaagcggaagaacacgtgaaatacttgattcgagaagcgtggaaagaaatgaatacagcaactaccgctgcaggatgtcctttcatggatgaattaaatgtggcagctgcaaatctgggtagagctgcccaattcgtgtacttagatggcgacggtcatggtgttcagcattccaagatccaccaacagatgggtggcttgatgttcgaaccgtatgtc

SEQ ID NO: 938 - DNA, 1521 bp, Valeriana officinalis
atgatcatggagttagttgaagctactagacgtactttgcgaaacgaatcaagcgactccaccgaaaaaatgcgtttaatagactcattacagagactgggtttgaatcatcactttgaacaagatataaaggaaatgttacaagatttcgccaacgaacacaaaaatactaatcaagacttattcaccacttctctgcggtttagacttttaaggcataacggcttcaacgtaacgcctgacgtctttaacaaatttactgaagaaaatggtaagtttaaggagtcactaggtgaagatacaattggtatattatctttgtacgaggcctcttacctaggtggcaaaggagaggagattttgtctgaggcaatgaaatttagtgaatctaaattgagagaatcttcgggacacgtcgcccctcatattaggcgtcagattttccagtctctagaattaccaagacatttaaggatggcacgtttagagtcaaggcgttatatcgaggaagattactccaatgagattggtgctgattcttctctgttagaattggcgaaattggactttaatagcgtacaagcccttcatcagatggaattgactgagatatcgaggtggtggaagcaattaggtttatctgataaattaccttttgcgagagataggcccttggaatgcttcttatggacagtcggtctattgcctgaacccaaatactcgggttgcagaattgaattggccaaaaccatcgctgtcttgttggttatagatgacatttttgatacatacggttcttatgaccaattaatcttatttactaacgcaatccgcagatgggatctggacgctatggatgaattgccagagtacatgaaaatttgctacatggcgctttacaatactactaatgaaatatgttacaaagtactgaaggaaaacggatggtctgttttgccgtacttagagcggacctggatagacatggtcgaaggtttcatgttggaagcaaagtggctaaatagcggcgaacagcccaatttagaagcatatattgagaatggcgttacgaccgctggatcttacatggcattggttcacttatttttcctaatcggggatggagtgaacgacgagaatgtaaagttgttgctggacccataccccaagctattttcatcagctggaaggattctacgtttatgggacgatttaggtacggcgaaagaggaacaagagagaggcgacgtttccagtagtattcaattatatatgaaagaaaaaaacgttagaagtgagtctgagggtagagagggtatagtagaaataatctataatttgtggaaggatatgaatggggagttgattggtagcaatgcgttaccacaggctataatcgaaacttcatttaatatggctcgtacaagtcaagttgtatatcaacatgaagatgacacttacttttctagcgttgataactacgttcaatcacttttcttcacgccagtttccgtgagtgtt

SEQ ID NO: 939 - DNA, 450 bp, Rosa hybrid cultivar
atgggcaacgagaccgtggtcgtcgccgaaaccgcgggctctattaaagtagctgtagtcgtatgtcttttgaggggccagaacgtcttattgggaaggcgtagatcatctcttggcgatagtaccttcagtctacccagtgggcatttagaatttggggaatctttcgaggagtgtgctgcaagggaattaaaagaagaaaccgatctggacatcggcaaaatagaactgttgaccgtaacgaacaatctgtttctggacgaagcgaaaccttcccagtatgtggcagtctttatgagggcagttcttgcagatccaaggcaggagccgcagaacattgagcctgagttttgtgacggatggggttggtacgaatgggataatttacctaagcccctattttggcccctggacaacgttgttcaagatgggttcaacccatttccgaca

SEQ ID NO: 940 - DNA, 441 bp, Arabidopsis thaliana
atgtctacgggcgaggccatcccgagggtggctgtagttgttttcatactgaatgggaacagcatccttctaggccgtaggaggtctagtatagggaattctacattcgcgttgccgggtggtcatttagagtttggggagtctttcgaggaatgtgcggccagggaagtcatggaggaaacgggacttaaaatagaaaaaatgaagttacttacggtcaccaacaacgtattcaaagaggctcccactccctcacattatgtaagtgtttctataagagcggttcttgtagatcctagtcaggagcctaaaaacatggaaccagagaagtgcgaagggtgggattggtatgattgggaaaatcttcctaaaccattgttctggcctttggaaaaactattcgggtcaggtttcaacccattcacgcacgggggaggcgac

SEQ ID NO: 941 - DNA, 1806 bp, Catharanthus roseus
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagagttcgtcatctagttcatcatcgtcgatgtctcttcctttggccactccattgattaaggacaacgaatcattgattaagtttctacgtcaaccactagtgctcccacatgaagttgatgattccacaaaaagacgagaattacttgagaggaccaggaaagaattagaactgaatgctgaaaagccactagaagccttgaaaatgatcgatataatacagagacttggtctgagttaccacttcgaagatgacattaactctattttaaccggtttctctaacatctcgtcccaaacccacgaggatctgctaacagccagcctctgtttcagattactacgccataatgggcataaaattaaccctgacatatttcaaaaatttatggacaataacggtaaattcaaggactcgcttaaagatgataccttgggtatgttgtctctctatgaagcttcatatttaggagcaaatggtgaggaaatactaatggaagcccaagaatttacgaagacacatttaaagaattcattaccagctatggcaccatctttatcgaaaaaggtttcccaggccttggaacagccacgtcataggcgaatgttgaggctggaagcacggcgatttatagaagaatacggtgcggagaacgaccataatcccgatttgcttgagttagctaagttggattataataaggtgcaatctcttcatcaaatggaattatccgaaattactaggtggtggaaacaacttggactagttgataaattgacctttgcaagagaccgacccttagaatgtttcctgtggactgttggtttattgcccgagccaaagtattctggttgtaggatcgaactggcgaaaaccatcgccattctactagttattgacgacattttcgacacccacggtacattagatgaacttttgcttttcaccaatgctattaaacggtgggacctggaggctatggaagatttaccagaatatatgcgcatctgctatatggcattgtacaatacaaccaatgaaatatgctataaagtgttgaaagagaatggttggagtgtacttccctacctgaaagctacatggattgatatgatcgaaggctttatggttgaagccgagtggtttaactccgattacgtcccaaatatggaagagtacgttgagaatggtgtcagaacagcaggctcatacatggcgttagttcatctattctttctaatcggccaaggtgttacggaagataatgttaaactcttaattaaaccataccctaaattatttagctcatcaggtagaattctgagattgtgggatgacctaggcacggcaaaagaagaacaagaaaggggcgatttagcttcctctatccaactttttatgcgcgaaaaggaaatcaagtcagaagaggaaggtagaaaaggtatcttggaaattatagaaaacttgtggaaggagttaaatggtgagctggtctacagagaagaaatgccgttggccataataaagaccgctttcaatatggctcgagcttctcaggtagtttaccaacatgaagaggatacttatttctcgagtgttgacaactacgtcaaggccttgttttttactccctgcttt

SEQ ID NO: 942 - DNA, 1680 bp, Ocimum basilicum
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagcaacatatggaggaatcttcgtccaagagacgtgaataccttttggaagagacgacacgtaaactgcagcgtaatgatacagagagcgttgaaaaactcaagttaatagataacattcaacaattaggtattggatactacttcgaggacgcaataaacgcagttctgaggagtccgttctctactggagaggaagacctttttacagcagccttaaggttcagactactacggcataacggtattgaaatatctccagaaatatttcttaagttcaaggatgaacgtggtaaatttgacgagtctgacacactaggtcttctttcattatatgaagccagtaatttgggcgttgccggggaagaaatcttggaagaagcaatggaatttgcagaggctagactacgtaggtccctttcagaaccggctgcaccattgcatggtgaagtggctcaagctctcgatgtcccacgacatctaagaatggcaagattggaagcacgacgttttatcgaacaatacggtaaacaaagtgatcatgacggcgacctcttggaattagctatcttggactacaatcaggtccaagcccaacaccaatcagaactgacggaaattatacggtggtggaaggagctaggcttggttgacaagttatcatttggtagagataggcctctagaatgttttctatggacggtaggattactgccagaaccgaagtatagtagtgtgcgaatagagctggctaaagcgattagtattttactagttattgatgacattttcgatacatacggagaaatggatgatttaattttgtttactgatgcgattagaaggtgggatttagaagcaatggagggattgcctgaatatatgaaaatttgttacatggcactgtataataccacgaatgaagtctgctacaaagtgttaagagataccggtcgcattgttcttttgaacttaaaaagtacttggatagatatgatagagggctttatggaagaggctaagtggtttaacggaggatcggctcctaagttggaagaatacatagaaaatggagtgtctacagctggcgcttacatggcctttgcgcatatctttttcctaattggtgaaggagtcacacaccaaaactctcagctgttcactcagaaaccttatccaaaggtattttctgctgctgggagaatattgcgactttgggacgatttgggtacggctaaagaggaacaagagaggggtgatttggccagctgtgttcaactatttatgaaggaaaaatcgctaacagaagaagaagcccgttcaagaattctagaagaaattaaaggcttgtggcgtgacttgaatggtgaattagtatataataaaaatctacctttatctatcattaaggtagcgttaaatatggccagagcatcacaagttgtgtataaacatgatcaagatacatattttagttcagtggataattatgtagatgccttgttctttacacag

SEQ ID NO: 943 - DNA, 1872 bp, Perilla citriodora
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagtcttctaaagcggcctcctgcttgcgagcctcttgtagtttgcaattggatgtcaaaccggttcaggaaggtcgtaggtctgggaattaccaaccaagcatatgggattttaattacgtccaatcgttgaacactccatataaagaagaaagatatttaaccagacatgctgaattaatagttcaggtcaaaccattactcgaaaaaaaaatggaacctgcacaacaattggaacttattgacgatctcaataatttaggtctaagttatttctttcaagatagaataaaacaaattctttcgttcatttacgatgaaaaccaatgtttccacagtaacatcaacgatcaagctgaaaaaagagacttgtacttcactgcactgggttttagactgcttagacaacacggttttgatgtttctcaagaagtgttcgactgttttaaaaatgacaacggttccgattttaaagctagcctttccgataatacgaaaggtctacttcagttatacgaggcttctttcttagtgcgtgaaggtgaagatacattggaacaagcccgtcaatttgcaacgaaatttctaagaagaaagctggatgagatagatgataaccatttactgtcttgtatacatcacagtttagaaattccactccactggagaatccaaaggttggaagcccgctggttcctggatgcttatgctacacgccatgacatgaatcccgtaatattggaattagcgaagctggactttaacattattcaagccacgcatcaagaggaattgaaagatgtcagcagatggtggcaaaacactaggctagccgaaaagttgcctttcgtcagagatagattagtcgaatcttacttttgggctattgccttattcgaaccacaccagtacggctatcagagaagagttgctgcgaaaataattacgttggcaactagtatagatgatgtgtatgatatttacggaactttagatgaattacaactttttaccgacaactttcgtagatgggatacggagtccctagggcgccttccttactcaatgcaactgttttatatggttatccataattttgtgtccgaactcgcttatgagatcctgaaggaaaagggttttatcgtcataccatatttgcaaagatcctgggtagatctagctgagtcttttcttaaagaagctaattggtattattccggttatacgcccagtttggaggaatatattgataatggctcaatatctattggcgccgtggcagttttgtctcaagtgtacttcactcttgcgaattctatagaaaagcccaaaatcgaatccatgtataagtatcaccatatcttgagattgtccggcctgttggtaaggttacatgacgacttaggtacgtctctcttcgaaaaaaaacgtggcgatgttcccaaggcggttgaaatctgcatgaaggaaagaaatgttacagaagaagaagcggaagaacacgtgaaatacttgattcgagaagcgtggaaagaaatgaatacagcaactaccgctgcaggatgtcctttcatggatgaattaaatgtggcagctgcaaatctgggtagagctgcccaattcgtgtacttagatggcgacggtcatggtgttcagcattccaagatccaccaacagatgggtggcttgatgttcgaaccgtatgtc

SEQ ID NO: 944 - DNA, 1686 bp, Valeriana officinalis
atgcagtataaactagcattaaatgggaaaactctaaagggcgaaaccactacggaagcagtagatgctgccacggcggaaaaagttttcaagcaatacgccaacgataatggcgtggacggggaatggacctatgatgatgcgacaaagacttttactgtcacggagatcatggagttagttgaagctactagacgtactttgcgaaacgaatcaagcgactccaccgaaaaaatgcgtttaatagactcattacagagactgggtttgaatcatcactttgaacaagatataaaggaaatgttacaagatttcgccaacgaacacaaaaatactaatcaagacttattcaccacttctctgcggtttagacttttaaggcataacggcttcaacgtaacgcctgacgtctttaacaaatttactgaagaaaatggtaagtttaaggagtcactaggtgaagatacaattggtatattatctttgtacgaggcctcttacctaggtggcaaaggagaggagattttgtctgaggcaatgaaatttagtgaatctaaattgagagaatcttcgggacacgtcgcccctcatattaggcgtcagattttccagtctctagaattaccaagacatttaaggatggcacgtttagagtcaaggcgttatatcgaggaagattactccaatgagattggtgctgattcttctctgttagaattggcgaaattggactttaatagcgtacaagcccttcatcagatggaattgactgagatatcgaggtggtggaagcaattaggtttatctgataaattaccttttgcgagagataggcccttggaatgcttcttatggacagtcggtctattgcctgaacccaaatactcgggttgcagaattgaattggccaaaaccatcgctgtcttgttggttatagatgacatttttgatacatacggttcttatgaccaattaatcttatttactaacgcaatccgcagatgggatctggacgctatggatgaattgccagagtacatgaaaatttgctacatggcgctttacaatactactaatgaaatatgttacaaagtactgaaggaaaacggatggtctgttttgccgtacttagagcggacctggatagacatggtcgaaggtttcatgttggaagcaaagtggctaaatagcggcgaacagcccaatttagaagcatatattgagaatggcgttacgaccgctggatcttacatggcattggttcacttatttttcctaatcggggatggagtgaacgacgagaatgtaaagttgttgctggacccataccccaagctattttcatcagctggaaggattctacgtttatgggacgatttaggtacggcgaaagaggaacaagagagaggcgacgtttccagtagtattcaattatatatgaaagaaaaaaacgttagaagtgagtctgagggtagagagggtatagtagaaataatctataatttgtggaaggatatgaatggggagttgattggtagcaatgcgttaccacaggctataatcgaaacttcatttaatatggctcgtacaagtcaagttgtatatcaacatgaagatgacacttacttttctagcgttgataactacgttcaatcacttttcttcacgccagtttccgtgagtgtt

SEQ ID NO: 945 - DNA, 1626 bp, Vinca minor
atgtcaatgccgttgtctatgtcacaacctattgccactccatttattacagataatgaatctctattaaagtttttaagacagccactggtcctcccacatgaagtagatgactctacaaagagacgagaattactagaaaggacaagaaaagagttgcaaatcagtgaagatcaacctttggaagcactaaaaatgatcgatactatagaaaggttgggcttagcatatcattttgaagaggacattaatagcctcctgaccggtttctccaatgcacaatccgacgaagacttgttgacagcatcattacgctttagattgctacgacacaacgggcacaagataaatccagatatctttttgaaatttatggataaaaatggtaaattcaaggaatctttaaaagaagagacattgggtatgttatctttatatgaggcaagctatttgggtgcaaatggcgaagacatattggagcaagctctggaatttactcaagcacacttgaaaaaaagcatctctggtgtcgcgccgccattatccaagaagatatcacaagccttggaattgccaagacataggaggatggcaagattggaagcgagacgttttatcgatgaatacggtggcgagtcagatcataatcctgatttacttgaattggctaagttagattataataaggttcaaagcttacatcaaatggaattatcagagatctctagatggtggaaacaattaggcttggtagataaactaacttttgctagagacaggccactagagtgctttctatggacagttggattgcttcctgaaccaaagtattctgcgtgcagaatcgaactagccaaaacgattgctatcttgctagtcattgatgacatattcgatactcatggtacactcgatgaacttttacttttcactaatgctattcgaagatgggatttagaagcgattgaggatttgcccgaatatatgaggatctgctacatggccctgtacaatactactaacgaaatatgctacaaagtcttgaaagaaaacggttggtcagtattgccatacctcaaggcaacttggatcgatatgattgaaggtttcatggttgaggctgaatggtttaacagcgattatgtcccaaatatggaagaatacgttgaaaacggtgttaccacagcaggctcttatatggcacttgtgcatctatttttcttaatggggcagggagtcaccgaggataacgttaaattattgttaaaaccatacccgaagttgttctcgtcctcaggtcggattttacggctgtgggacgacttaggaaccgccaaggaggaacaagaaagaggcgatttagcctccagcattcaactattcatgagagaaaaaaatattaaatccgatgaagaaggcagaaagtgtattttggaaattatagataagttgtggaaagagatgaatggtgaagttgtctcacgcaacaactccttacctctaccaatcattaaagttgcctttaacatggccagagcttcacaggtagtataccagcatgaagaagattcatatttttcttccgtagataattacgttcaaagcttgttttttacaccatttaat

SEQ ID NO: 946 - DNA, 1623 bp, Cinchona pubescens
atgtgtttaccctcccagaccttaacccaaccaatagcaacacctttaattacagataatgattctctactaaaatatttgaggcaaccacttatgctgccacatgaagtcgatgatagcactaaaaggaaagagttattggaaagaacgagaagagagttgcgttctacaaccgagccattggaagctatgaaattgatcgatacgctgcaacgattaggtattgcgtatcactttgaagatgatatgaacgtcatcctatcttctttcagttcagatggtcagtcagatgaagatttgtttacagcagctttacgctttagactacttagacataacggtcataaaatcagtcctgacatctttcaacgttttaaggatcacaaaggaaaatttaaagattcgttgaaagaggacactcttggtatgttatcactttatgaagcctcacacttaggagctaatggagaagacatcttatcagaggccatggagttttccgaagctcatttgaagaagagcttacctaagttggaacctttacctgctaagcatgtctcaaaagctttagaactacctcgacaccgtagaatggctagattagaagccagaagatacatagaagaatatggtaaagaatcgggacacaatcccgatcttttggaattggccaaattagactacaataaggtccaatcattacaccaaatggagttgagtgaaatcacaagatggtggaagcaactgggtttagtcgataaattaacctttgcacgggatagaccactagaatgcttcttgtggacagtaggcatattgcccgaaccaaagtattctagttgtcgtattgaattggctaagacgatagctatccttctggttatagacgatattttcgatactcatggtaccgtagacgagcttgtgctgtttactaacgcaatcagacgttgggatttagaagcaatggaagaattgcctgaatacatgaagatatgctatatggccctgtataatacgactaacgaaatttgttacaaaatcctaaaggaaaaaggatggtccgtgctgccctatctcaaaagtacatggattgacatgattgaggggttcatgatggaagcttcttggtatagtaatgctcaaatccctaacatggaggagtatgtggaaaatggagttacaacagcgggcgcatacatggcactagttcacctgttttttttgattgggcaaggagtcacacaagataatgtcaagttgctgatgaaaccttatcctaaacttttcagttcttcgggacggattcttagactgtgggacgaccttggaactgctaaagaggagcaggaaagaggagaccttgcatctagtatacagcttttcatgcgagaaaataacataacatgtgacgaggaaggcagaaagaggatattgctgcttattgataatttatggaaagatctcaactgggaacttgtatcaaggaacgaactgccactgagtattattaaagcagcttttaacatggcccgagcaagtcaagtagtataccagcatgaagaggactcttatttttcttccgtagacaattacgtgcaagcgttgttttttacaccgatc

SEQ ID NO: 947 - DNA, 1569 bp, Rauvolfia serpentina
atgaacttgtcactgtccttttgtgctaacctgtggtgttttcttatgagattaatgagaactacaagagggggtaattgttggaaagaacaagagaaaaatttgttgacatcagcagaccaaccactggaagcacttaaaatgatcgatactctacagagactaggtctagcgtaccattttgaggacgacattaattctatactcacaggattctcctcgtcacagtctgacgaagacctgttgacagcagctttgaggttcagactactacgtcacaacgggcacaagattagttcggatgtcttccaaaaatttatggataataagggtaaatttaaagagtcccttaaggaagatacactgggtttgctctctttatacgaagcttcctatcttggtgcaaacggtgaagatatcctaatgcaagctctagaatttacccaagcccatttaaaaaagtcattaagcggactagctccacctcttgccaaaaaaatttcgcaaggattagaattgccacggcatagaagaatggcacgtttggaggcccgtagatttattgaagaatatgggggtgagtcagaccataagcccgacctacttgagttggccaaacttgactacaataaagtgcagtccttacaccagatggagctaagcgaaataacccggtggtggaagcaattgggtttagttgataaacttacctttgcccgggatcgtcctttggaatgttttttatggactgttgggatcctacccgagcctaaattttcagcttgcagaattgagttagcaaaaactattgcaatattgctggttatagatgatatatttgatacgcatggtacaatcgacgagttagttttgtttacgaatgctataagacgctgggacttggaagccatggaaaacttgcctgagtatatgagaatttgttacatggctttgtataatacaacaaatgaaatatgttataaagtactcaaggaaaacggttggagcgttcttccttacttaaaggccacctggattgatatgatcgagggctttatgctagaagctcaatggtttaattcgggctatgtcccgaatatggaggaatacgtggaaaatggtgtaaccaccgccggagcttatatggctcttgttcacctatttttcttgatcggtcagggtgtaacacaggaaaacgttaagcttttggttcgtccttatccaaagttgttcagttcgagtggtaggatcttaagattatgggatgatttgggtactgctaaagaagaacaagaaagaggcgatctagcaagttcaattcaattatttatgagggaaaactcaatcacgtcagatgaagagggaagaaaacgtattttgcaaatcatcgacaacttatggaaggagttaaacggggaactgatgtcccggaatgcgctacccttggaaattgtcaaggcagccttcaatatggctagagcatctcaagtagtatatcaacatgaagaagattcttatttctcctcagtagataactatgttcaagcactgttttttacaccttttaac

SEQ ID NO: 948 - DNA, 1758 bp, Swertia japonica
atggtaataactagaaatttcgcaagtttttcggaagtatgtatcagttctggtaccctatttagctacctgagaaggcaatacaaccagtatccgatcgctaaaacttcgcatatatgtatgtgtatgccgttatccacatctacaatgtctagccaaccaatagcaacacctctcattaaagataatgaatctttgcttaggtatttgagacaaccaatggtcctaccacatgaattagatgatgatactaagcgtagggaattagtagagcgtacacgtagagagttgcaaagcatgagtaaaccccttgaagcaatgaagatgatcgatactttggatagattgggcattgcataccatttcgaggacgatattaacgctatacttacaaccttctctaaaaatgctcaacctaatgaggatttattgacgacaagtttgaggttccgtctgttgaggcacaacggttttaaaatttctccagaaatatttgaaaaatttttagatcaaaatggtaaattcgaagagtcattgacaaaagatatcccaggtttgatctcgctatacgaagcatcctatatgggtgcagggggcgaagaaatcttacttcaggcacttgaattttctgaaggccacttaaaatcttcaaagaacaatttaacccctcaactcagtcgccaagtatcgcaagctttagagctgcctagacatagacgtatggctagattggaagcaagaagatatatcgaagagtattctaaagagaaccaatataataatcctgacttgctggagcttgcaaaattggactataataaagtacaggctttgcatcagatggaacttacggaaattacaagatggtggaagcaattaggattggtggataaacttccatttgctagggatagacccctagaatgctttctatggactgttggtcttatgcctgaacctaaatattctggttgcagaattgaactggcaaaaaccattgcgatcctgttggtcatagatgacatattcgacactcatggcaccattgatgaattggtactattcaccaatgcaataagaagatgggacctaaaggccatggaagagctccctgagtatatgagaatctgttatatggccctatacaataccacaaacgagatttcatacaagattcttaaagaaaatggttggtcagtgcttccatacttaaaggccgtatggatcgacgtagttgacggattcatgatggaggcctcttggttttccaatggacaagtaccaaaagttgaggaatatttggaaaatggggttactaccgcagggagttacatggcactggttcatgtcttttttctaatcggtaagggtgttaccgaagaatccgtacaactactgatgaacccgtaccccaagctattttcaaatagcggtagtatcctgcgtctttgggatgatttgggaactgcgaaagaggaacaagaacgtggggatgtggcgtctattataatattgtttatgaaagaaaaaaacatcacttcagatgaggaagcaagagagtgcattctccagttaattcataacatttggaaggaattgaacggtgagctagtatctagaaacggtttacctcttgaaataaaaaaagtagctctgaacatggcaagagctagccaagttgtttatcaacatgaagaggatacttatttttcaaatgtcgataattatgttatggctttattctttactccatttaat

SEQ ID NO: 949 - DNA, 1440 bp, Coffea canephora
atgaatctaatcgatacattgcagagattaggcttggcgtatcatttcgaagacgatatgaatgctatcttaagccaactatcatccagtggacaatctgatggcgatttactgactacagctctaaggtttcggttattaagacataatggtcataaaatatcttccgacattttccaaaagttcatggataaaaacggcaaattcaaggactctctcaaggaagatactatgggcttattgtctttgtacgaggcctctcaccttgcggctaacggcgaagacatcttgttggaagccatggagttgacggaagcacacctcaagcaaagtttaccatctctgcccacacagttggctaggaaggtgtcctctgcattagaactgcctcgtcataggagaatggcaagactggaagctagacgctatatacaagaatatagcgaagaaattggtcatgatccaaatctgcttgaactggcaaaattagactacaataaagttcagagtttgcatcagatggaattaacggatatttctaggtggtggaaacagctcggcctcgttgataagttaacattcgcaagagatcgtccattggagtgtttcctatggacggttggaattttaccggaaccaaaatattcaaactgccgaattgaactagctaaaaccatagcaattttattggtaatagatgatatatttgatacacatggcactatagacgagttagttttgtttacgaatgctattagaagatgggacttggaggctatggaaggacttccagaatatatgagaatttgttatatggctttatataatactaccaatgaaatatgttataaaatactaaaagaaaacggttggtctgttcttccatatttaaaggctacttggattgatatgatcgaaggtttcatgttggaggcaagttggtatagtaatggtcaagaaccaaatatggaggaatatgtcgctaatggcgttacgacggcagggacctatatggctatggttcatctgtttttcttaataggtcaaggtgttaccgaagaaaatgtaaagctcctaatgaaaccttaccctaagttgttctcctgttctggcaggattttgcgtttatgggacgatttaggtacagccaaggaagagcaagagagaggtgatctagcctcttctatccagctattcatgagggaaaataatataacttgtgatgaagagggtagaaaaaggattctccagttgatcgataacttatggaaagatttaaactgggggttggtcagtaggaacgctatgcctttggcgattattaaagccgcatttaatatggctcgttcttcacaggttgtatatcagcacgaggaggagtcatatttctcctccgtagacaattatgtggaatcgttattctttacaccaattataaac

SEQ ID NO: 950 - DNA, 1827 bp, Citrus unshiu
atgagagaaaaaatgattagttgtgaagaggaagcaagaaagcatatacgtcagttgatcagatcactttgggtggagctcaacggcatgctagtggcaccagctgctctgccggcttcaatagtcaatgcctctttaaatttagcaagaacagctcaagtcgtctatcaacatggagatgattcaacggttactagcgttaatggacatatcgaaaggcttttaaatggaggtaattgctggtctataaaggaggatgaaaaatttatggaattcgtcgatgactcactgctgcagttctgtaaaagaaaaatgcttaaataccagctagtctggttagttaacggacttgggctggctatcgaaaagatgatggtcagatggttgaccggggagtgctcattactggaagatctattttgttttgactgttgggacttaaaacatttttgtgtttcccgcgccgtcaagttgaagttagacatgctgggatgtaaaatggaagccacccctttccttgaaacttctggaggctcaggctacacaaggctggacaaaatcaacgtaggtaaggccgtagagtatatactaagttgtagaaatttggatggaggcttctggtggggtgtcagctgcagagcaaactatgcttcctatctcgccacgcaagatgaggatattctttttcaagctatggaatttactaaaactgaacttactcagtcagtttctttaatggattcccaatcatctaggcatgttgttcaagcattggcactaccaaggcatttgcgcatgtcacgatcagaagccggtaattacatcaacgagtattctcaatcgtggaatcatgatcaaaccttactgcaactggcaaaatctgactttaatatggtccagtcattacatcaaagggagctggcagaaattaagagatggtggaagcaactcggtctagtagataagttaggcttcggtagagatagacctttagaatgttttttgtggaccgttggaatctttccagaaccatactattctaactgtaggattgaacttgccaagaccatagccttgttgctagtaatcgatgatatttttgatacctacggtagtttgtccgatttggtcttgtttacggaagctattcaaaggtgggatcttggtgctatggaacacatacctgagtacatgaaaatttgttatatggcactctataatactacgaatgaaatttcatatagaattttaaaagatcatggttggaacgtagtgccgcaactaaaaaggacttggattgatatttttaaagcccaattgtcggaagcgaaatggttttcggagggctacgtcccaacacaagaacaatatctaagaaatggagtcactactggcggtacctatatggcacttgtccatgccttctgcttaatgggacaagatgttactaaggaaaccttggcaatgatggaaccttatcctaatctattttcatgctccggtaagatattgcgcctttgggatgatttaggagctgctagggaagagcaagaaagaggtgatgtcgcctcaagtatcgaatgttatatgagagaaaagacaatatcttgtgaagaagaagctcgtaaacatataagacaactgataagatccttatgggtagagttaaatggtatgttggtcgctccggccgccctcccagcatcgatagttaacgcgtcattaaacttagctagaactgcgcaagttgtttaccaacatggtgatgataacacagtaacatctgttaatggacatattgaacgcctgttttgcaatcctctaacc

SEQ ID NO: 951 - DNA, 1236 bp, Citrus unshiu
atgcaaccggaagagaacttgtttgagaatgcattagccttttatgtgtgcatagaggcatcttatttagcaactcaagacgaggatattctattccaagcaatggaatttaccaaaactgaattaactcaatctgtttcactgatggattcgcaatcatcgaggcatgtagtgcaagcattagctcttcccaggcacttgcgaatgagtagatctgaggcaggaaattatattaatgaatacagtcaatcttggaatcacgatcaaactctgttgcaacttgcgaaatccgattttaatatggtgcagtctttgcaccaaagagagttggcagaaattaaaaggtggtggaagcaattagggttagtagataagcttggctttgggcgtgatcgcccgttggaatgtttcctttggacggttggaatctttcctgaaccctactattcaaactgtagaattgaattagcgaagactatagcgctattactagttattgatgatatttttgacacttatggcagtttatctgatctggttctcttcactgaagctatccaacgctgggacttaggtgccatggaacatatccccgaatacatgaagatatgctatatggcattatacaacaccacaaatgaaatatcgtatagaatattgaaagaccacggctggaacgttgtgccccagcttaaaagaacatggatcgatatcttcaaagctcaactaagtgaggcaaaatggttttccgaaggttatgttccaacccaagagcaatacctccgtaacggtgtaaccaccgggggtacttatatggccttagttcatgcattctgtttaatgggacaagatgttactaaggaaactttggctatgatggaaccgtatcctaatttattttcgtgttcaggtaaaatattgcgcttgtgggatgatttgggcgctgccagagaagagcaggaaaggggagacgtcgcatcttcaattgaatgctacatgcgggaaaagactatcagctgtgaagaagaagccagaaaacacattcgccagttgatcagatctttgtgggtagaacttaacggaatgcttgttgcaccagcagcattaccagcttccatagttaacgcctcactcaaccttgcccggactgcgcaagtggtgtatcaacatggagatgacaatactgtaacttctgttaatggtcatatcgagaggttgttttgtaatccattaaca

SEQ ID NO: 952 - DNA, 1728 bp, Glycine soja
atgacaagttctctggagtcaatggaggcttgggcagctgcttctctggcacttacggtcagtagaagatccacgcaagctgctaaatctagtgtttacatcattaaggaaagacaagttgaaccaattgtaatttcaagaggtcgtagagaaaggttaaattatctggttccctcccaaacatatttgggtacaaaagatttagatcaggtcataagaaagggccaggaagctctgttgaactcctctgatcccttgcgtacactaaaaattattgatacaatacaaaaattaggcattgagcatcatttcgaaaaggaaattaacttgcagctaggacgtgtgggtgattgggacactgctgaagatctattcgctactgctttgcagtttagattacttcgtcataatggatggcctacttgtagcgatgtcttcaataagtttttagataagtccggcaactttaaggagtccgttacaagggacatttgggggatgctctcactgtacgaggccagttacttaggcgctaagggtgaagaagtgctacaacaagctatggattatagtagagctcatttgtgccaatcgttgcctcacttgagtcctaaagtacgcagtatagttgcggaagctctaaagctcccccgtcatcagagaatggttggattggaagcaaagaattatatggtggaatacagccaggcctctaatcaaattcccgccttgttaaaattagcaagattggattacgatatgatacagtccatgcaccaaaaagagttggctgagattagtagatggtggaaggacctaggtttaattgaacgactaggtttcggtagggacggtccaagggaatgtttcctatgggcattaggcatctttccagagccgaggcattcgagttgtaggatagaattagcaaaagcaatttgtgtattacaggtcatcgacgatgtctttgatacatacggcactttggatgaattggtgctatttaccaaggctatcaagagatgggatctagacgcgatggagcaacttccagagtacatgaagatctgctatatggccctgtacaacacaacccacgaaattgcatataagatccagaaagatcactctttgacagtagttgcttgtttaaaaattacatggatagatttgatagaggcttacttgaaagaagccaactggtttaataataaacacgtgccaacctttcaacaatacctagataacggtgttatatcttccggtagctatttggcactcgtccacgctaccttcctcataggggatgacctaagcaaagaaactatattcatgatgaacccttatccaagattgttctcctgctccggtaaaatactaaggttgtgggatgatctaggaacttcaagagatgagcaggaaaggggggataatgcttgctctattcaatgcctaatgaaacagaacaatatctcggacgaaaatgttgctcgtaaactaatacgtcagctaatcgataacttatggccagaattaaatggcttaactatgaccacgaatctaccattatcggtgatgagggcttcattgaacatggccagaactagccaagtgatttatagacatggtgatgaccaaaatatgccaactgttgacgaacatgttcaaacattattgtttaccccttcaataaactacagggacgaaaatgacattaatcatgttata

SEQ ID NO: 953 - DNA, 1626 bp, Cynara cardunculus
atgtgcttaagcttttctacccttccctcgtcaacaatagcagtgcccttaaatagggataatgatagtctcttacacgtttatcaaccgaaagcaatcttgccaaaggccgttgtttatgacagaatcgaacaacttaaagaaaacacgcgtagagctctgatgtccatctcagaccctattactagaatggagttgatcgataccatacaaagacttggggttggtcatcatttcgatgaagaaatgcatgagattttggaaaatttaacagaggatttgccagatgacaatttgtatgctgtagcactatgcttccgtttgcagaggcacaatggtctacatacgaacccagatgtcttccaaaattttatggatgctaatggtaaattcaaaatgtcatcctctgatgatattgaagttttgttgtccttatacgaagcttcctacttgggtgctaacggtgaagacattttatctcaggcaaaggaatttacgactatgcaacttacttcactagtgagtcaacttaatcctaagctaggcactaaggttttattgtctttgggcttacccagacaccttagaatgacaagactggaagcaagacggtacattgatgaatatggtaatgaagacgatcataatccaatcgttttagaattagccaagctggattataatcacgtgcaatccctattacaaagagaactggtggaggttactcgctggtgggaacatttaggtttattgaaaaaactgagctttgttcgggacaggcatttagaatgctttctatggacagtaggtgtattaccagagaaaaaatattctggtggtcgaatcgagttggccaagatcattgcgattttgttagtaatcgatgatatctacgacatttacggttcctatgaagatttggttttgtttacagaggctattcgaagatgggacctgtctgaaatggaacatttacccgaatatatgaagataagttatactgctttgtataatacaacttctgaaatatgtcacaaaatattaaaggagcatggtttatccgtcgaaccattccttcatcaaacctggatagatatggttgaagcttatatggttgaagtggaatgggtgcgatcagggacgatgcccactttcgaggattatattaagaatggggttaccacaagcggaacgtgtatggcgttagttcatttattctttttaatatcagaaggagttaccgaggaaaatatgagacacctgcttgacccttaccccaaattcttttccctcgctggcacgatactaagactatgggatgatttaggtacctcaaaagaagagcaagaaagaggtaacgttgcatcgtcgatacaattattaatgcgggaaaaaaatattacaagtgaagaagaaggtagaaagaaaatcttgcagttaatcaacgaattgtggaaagatcttaacacagaactggtgacgccagatgcgctgctcctacctatgattaaggttgcactaaacatgagtagggcatcccaagtggtttatcaacacaatgaagatagctatttgacctccgttgaatctcaagtacagtatttgttttttaaaccgattgatata

SEQ ID NO: 954 - DNA, 1452 bp, Dorcoceras hygrometricum
atgaagctgatcgataacttacaatggctaggacttgggcatcatttcgaagatgaaagcaacttgtggctggaaaagctgtcgggtgagagtgcatccgtagatgaagatgacttacactcaacggccttgttattcagactcttaagacaacatatgaaacctataaattgtgatattctggaaaaatttactagagatcaaaatatcagagactcattaattaaggacaaggaaggtttactgtccttatatgaagcttcctacctcggatcaaatgacgagggtgttttgtcagaagcgatgaaatttactgagactttattgatcaaatcaccagtcaggccagaatgcgatctctcgcagcggataggccgagcgctagaacttccaagacatcgtaggatggtacgtctcgaatcaaggagtcgtattaaggagtatggcatgcgaacttcacaaagctctagactgctgcaattggccaagttagattacaacaaagtacaattgttacatcaaatggagctagctcaatttactagatggtggaaacaactaggattggcagataagttgggatttgtacggaactctacggctgaatgtttcctttggacagtcggactattcccgcatcctaagtatagtggtgttcgcgttgaaatggccaaggttattgctatattgttagctatagatgatgttttcgacaagtacggcaccatgaacgacttatccttgttcaccctcgcaatccagaaatgggaccttgatgcgatagagactcttcctgaatatatgaagatgtgttttatggctttgtataatacaacaagggaaatcgcaaacaaagttttaaaagagcacggtgtagatattcatcatttcttggccagatcttggattgatactatcgaggcctttatgatcgaattcaaatggttttcccgaagagaagagccaatctcagctgaagattacatggaaaatggcgcagcaactgcaggtgcatatatggctctagtgcatgctttcttcttgatgggtgaaggtctaactaaccacaatatcaagcttatgtctaaaccataccctgaattattttctgcatccggaagaatactgagattgtgggacgatctggggacctctaaggaagaagaagatcgtggcgattccgcttccatcataggtatcctgatggaggagaagaacctatcatctgaaaatgaagctcgacaacatataaaacagactatcttaaacctgtggaaagatctaaatggaaatttaagtaccgactcgattaaccctttaccattgccaattatcaacgtctgttttaatatgtgcagaaccgcacaagtcttttatcaacaccaggaatactcttatgtttctaatgtcggtaggatggctgatgtcattttttttgaacacataggtatt

SEQ ID NO: 955 - DNA, 1554 bp, Dorcoceras hygrometricum
atgaaaagatcaactataggtattgaggaactgactgagaaggcacgtaaagaattgcagatcctaaattacatcgagcctgttcgtggtatgattttgattgataatttacagtggctaggtattggttaccatttcgaggacgaaattaatctatggttagataagctgagtgagtgggactgcggtgaagatgaccttcatgcaactgctctaagatttagacttctgagacaacaactaaggcctacaagttgcggcagtgtatttgagaacattctggaggatcacaaaaagagaaagagcaaaccttctctgaaccaagtcgaaggcttgctaaacttatacgaagcatcatatttgggtgcatcgggtgaggaaatattgtctgaagcgatgaaatttgctgaaacgcaactggctagcttggtgaacggcacatgtggtactgccgacggtaatttgtatcgaagaatctcacttgcattggaattgccaaggcaccatcgcatggtacgtttagaaagtagacgtcatattgaagattgctcaactcatattcattgctcaccatccatgcatctggtggagctcgcaaagctggattataacagagtacagttgctacacaagatggaattggaagaatttaggaggtggtggagacaactaggtttggtaggtgaattgtcatttgcaagggatccagaagcagaatgtttcttctgggttgttggttgcttccctgatcctagacattcgggtgttcgcatggaaatggctaagaccattgcaatcctcattaccatagacgatgtatttgataagcatggtacaattgacgagctattattgtttactcatgctgtccagcgatgggatgttgatgcaattgaaaatctgcctgattacatgaagatttgctatatggctctatacaaaacaactactgaaatcgctcaaaaaattttaaagcagcatggaatagacgttctacactttttgtctagagcatggattgacactattgaagcttacatgattgaagctaaatggttccagaacggccaaattccctcagtagaagattacatagagaacggtacaacaacgggcggatcttatatggctctagttcatgctttcttcctgatgggcgaaggtatcactaaccataatatgcagttgatgagaaagccatatccaaaactgttctccacaagcggtcgtatattgagactctgggatgatctgggcacaagcaaagaagaacaagacttcggcgataactccagtttgatcccagttttaatgaaagaaaagaatttgtcaagcgaggacgaagcacgcaggtgcatcaaacaatttattcgccagtcgtggggtgaattgaacaccaacctattagagtctaacatttggcctttatcactgattaatgtttgttttaacatgtgtagaacttcagaagcgatttaccatcaccaagagtcatcctacttgtcctcgttcaagaggacagccaagattaagttattagaaccaatcacgaat

SEQ ID NO: 956 - DNA, 1362 bp, Helianthus annuus
atgaacaccagcgattcgacaatgacgttaaagttgatagatactatccaaagattaggtgttggttactattatgaagaagaaatcaaaaagatcttaaaaaaattgacacatgtgctccccaaagatgatctatatacggttgcactgcactttcgcttgcaaagacactacggacttcataccaatcctgccgaagtatttcgtatctttatggatgaaaacggagaacttaaaaaatcaagttccgaggatattaaaggtgtgctcagcttatatgaagccagttgcttaggtagttcgggtgaagacttcttattgcatcacaaggaaattacacgtaggcatttatctagatctgtatcaaaactgtcaccaaagttgcacaagaatgtcgttgaaggtctcaagcttccgagacatatgagaatggaaagattagaagccagaagatatattgaggaatacggcaacgaagatgaccataacccattcgtattggaatttgccaagtggtgtgaacaccttggattattttgtaagttagtattcgtgagggatagacacgtcgaatgtttcttgtggacagttggcctgttgcctgaaccctctttctccggaagtagaattgaattggctaagactattgccataatgttagtcattgatgatatttacgacacctatgggtcttatgatgatttggtcctatttaccgaagctattaagagatgggatttgaatgctatagagcaactacctgagtatatgaagatatgttaccaggccttgtataacacgaataatgaaatctgtgacaaatggatagatatggctgaagcatatatggtagaagcagaatgggtaaagcgaggttcgatcccaaacttgaatgattacatagaaaatggtgttacaacttcaggaacctatatggcattagttcacctgttttttcttatttcttacgggctaaccacggaaaatatgaaacaccttttagatccataccccaaattcttcactatggccggtacaatcttacgtttgtgggatgacctaggtacaattaaagaagaagaggaacggggcgatatgttatctagcattcacctgcttatgaaagaggagaatattacgtgtgaagaagaagggagagagggtattctgcagatgatttatgcgttgtggaatgatttgaatgttgaattattgacgcctgatgcggttttgtttcccatgataaaagtggcacttaatatgtcaagaacatcacaagtggtttaccaacataatgacgactcctatctattgagtgtaaaggatcatgttcagagcttgttctacgaacctgttgatatc

SEQ ID NO: 957 - DNA, 1200 bp, Actinidia chinensis
atgctttctctgtatgaggcttcttatttgggtgcatatggagaagatatattgagtcacgctatggaatttactgactccaggttaaaacagtcagttccttttatggcaccacaactaggtaagcacgtttcacaagcattggaactccctagacatctacgcatggagagattggaggcttctagatttattgctgaattcgggagagaatccgatcaatcatctcaattgttggagttagcaaaaatggattacaacaaagttcaatctttgcatcagacagaactagctgaaataagtaggtggtggaaacaattgggcttagtggataaattgtctttcgggagggaccggcctttagaatgttacttatggtctgttggtttgctacctgaaccaaaatactcagactgtagaatcgagttagctaagacggttgcaatattgctggttatagatgacatttttgacacttacggttctcttgatgagctggttttgttcactcaagccattcgcagatgggatctgagtgctatggagcaattgcctcagtacatgaagatatgttacatggcattatttaacactaccaatgaaatcggttacaaggtactaaaagatcatggttggtccgttgttccacatttaaaaaggacgtggatcgatatgatagaagcatttcttgttgaggctaattggttttctaatggttacgttcctaacttggaagaatacctcgaaaacggcgttactactgctggtagctatatggctctagttcatttatttttcttgattggtaaaggggttacaaaggaaactataggtatgatggatccataccccaagctgttttcgtcttccggaaggattctacgtctttgggatgaccttggaacggcaaccgatgaacaggaaagaggagatgtagcttcttctatagactgcttccgtagggaaaaaaatttgtctacggagggtgaggcccgcaaccatgtaaaaaaacatatccgttctctatggaaagagctgaatggagaattaatggccccaaaggcgttacctctaccgttgatcaaaacatcattcaatatgtccagaaccgctcaggttatttatcaacatggggacaacaatacatttccatgcgttgacgactgtgtacaaagtttattctttactcctattggtttc

SEQ ID NO: 958 - DNA, 1623 bp, Cinchona ledgeriana
atgtgtatgcctagccaaacattaacccaaccaattgctactcctctgataacggataacgactccttactaaaatacttgagacaaccgctgatgttgcctcatgaagttgacgatagtactaaacgtaaagaattattggaacgtacgaggagggaactgagatcgacaactgaacctttagaagctatgaaattgatcgataccttacaaagattaggcatagcttaccattttgaggatgatatgaatgtcattttatcttctttttcttctgacggccaaagcgatgaagatttgtttacggcagcattgagattccgtctattgaggcacaacggtcataaaatctcccccgatatctttcagagatttaaagatcataacggaaagtttaaggatagtttaaaagaggatactttgggtatattatcgttatacgaagccagccacttaggcgcaaatggcgaagacatactgcttgaagctatggaattttcggaagcgcatctcaaaaaatcgcatccgaagttagaacctctgccagctaaacatgtatctaaggccctggaattaccaagacataggagaatggccagattagaagcaagaaggtatatcgaagaatacagtactgaatctggacacaacccagatttgctcgaacttgctaagttagattataataaggttcaatctctgcatcagatggagttgtcggaaattactaggtggtggaagcaattgggtctggttgataaacttactttcgcaagagatagaccactcgaatgcttcttgtggacagttggaattttgccagagccgaaatactcctcttgtcggattgaactagcgaagaccatcgctatcttattagttatagacgatattttcgacactcatgggacagttgacgaactagtactgttcacgaatgctatccgtcgttgggatctagaagctatggaggaactaccagaatatatgaaaatttgctatatggctttgtataacactaccaacgagatctgttataagattctaaaagagaaaggttggtctgtactaccatatctaaagtcgacttggattgacatgattgaaggctttatgatggaagcttcatggtactcaaacggtcaaattcccaatatggaagaatacgttgaaaacggtgttaccactgctggtgcctacatggcgttggttcatcttttttttcttattggtcaaggagtcactcaagacaatgtaaagttgctaatgaaaccttatccaaaattatttagcagctctggtcgtatcctgagactgtgggacgatttaggcacagctaaggaagaacaagaaaggggtgacttggccagttctatacaattgttcatgagagaaaataatattacatgtgacgaagaagggcgaaagcggattttgctacttatcgacaatttgtggaaagatttgaattgggagttagtttccagaaatgaacttcctttgtccataatcaaagctgcctttaatatggctagggcctctcaggtagtttatcagcacgaggaagactcttatttctcaagtgttgataattacgtccaggccctctttttcactcctata

SEQ ID NO: 959 - DNA, 1473 bp, Lonicera japonica
atgcaacaagaatcctcaaatccaacggataaacttaaacttatagatacattgcaaagactgggggtcgcctaccattttgaagaagacattaactctctcttacaaggtttttctaatggccaaccgaatgaaaacgaatacgatccctttacgactagtttgcgatttaggttgcttagacacaacggatatcacgttagtactgatgttttcaagaagttcatggacaaaaacggaaaatttaaggagagcctgggtggtgacttgatgggcatgttgtctctttatgaagcttcccacttgggtgcaaatggtgaagatattttatcggaggctatgaagtttactgaaaccaaattaaaagaatccgccgcgcacgtggctcctcaaattagaagacaaattttgcaatctctagaactaccaagacatttgagaatggcgcgtcttgaatcccggagatacattgaagaatatggcagggaatctggtcataatctggctttgctagaattagccaaattagactacaacaacgtgcaaagtttacatcaattagaacttgcagaaattagtagatggtggaagcatttagggctggtggataaattgacctttgctcgggacaggcctttagagtgttttttatggactgtaggtttgctacctgagcctaaacatagtggctgtagaattgagctagcaaaaacgatagccatactactagtaatcgatgatatcttcgatactcatggaagctttgatcaactggttctgtttaccaacgcaattagaagatgggatttgaatgctatggaggagctacctgaatatatgaagatctgttatatggcgctatacaacacgaccaatgaaatttgttacaaggtattaaaagaaaatggttggtctgttttgccttatcttaaaaggacttggattgatatgatagaaggtttcatgctcgaagcggagtggttgaactctggccatgttccaaacttggaggagtacattgaaaacggagtaaccacggctggtagctatatggcattagttcacttatttttccttataggtgaaggagtcacggatgacaacgtcaaactattattggatccatacccaaaactgttttcgtgttccgggagaattttaagattatgggatgatctgggtacagcgaaggaagagcaagagagaggtgatgttgcgtccagtattcaattgttcatgagagagaacaacgtgtcatctgaaggagaagccaggaagcaaatcattgaaatcattcagggactatggaaggaactcaacggtgaacttatgggccccaacgccttacctcttccaataataaaaacaagtttcaatatggctaggaccagtcaagttgtgtatcaacatgacgaagattcatattttagcagcgtagattcttatgtgcagtctttattcttcactcctatt

SEQ ID NO: 960 - DNA, 1671 bp, Cinchona pubescens
atgagttctaaaaaaccctcgcatatatgtatgtgtatgcccatgccgtctaccactagcacgcaactaattgctacaccgcttataagagataatgaatcacttttaaagtatttgagacaaccaatggttttgccacatgaagttcaacccatggtgttaccccatgaggttgacgacggtactatgagaaaggaactacttgagattaccagacgagaactaatctctactccggaacccttggaagctatgaaattgattgacactattcagagattaggattagcatatcacttcgaggatgaaatgaacgctatcctctctggcatatcaagtaagataccctatgaacacgaagacctcttaactgcgggattaagatttaggcttttacgtcacaatggacaaaagatttctcccgatatatttaaaaagtttatggattctaacgggaagttcaaagagtcattgaaggaggatactataggtttattatgtttatatgaagcttcacacatgggagcgaacggtgaagatatcttattagaagcgttagaattttcagagtccaacattagacgttctctttcttccctccagccacaattggcacgtaaagtctcacaggccttagaacttccacgtcacaggagaatgataaggttagaagctcggcggttcatcgaagaatatggtcaggagagtgggcataatcccgatctattggaattggctaaattggattacaacaaggtacagtctttacatcaaatggagctatccgagatttctagatggtggaagcaattgggtctggtggataaattaaccttcgctagagatcgtcctttggaatgtttcttgtggaccgttggtttgttgccagaacctaagtattccgcttgtcgaattgaactcgctaagacaattgctattttgttggtaatcgacgatatattcgacactcatggtacaatagatgagttggtcatgtttaccaatgcaataaggaggtgggatttagacgcaatggaagaactgccagaatacatgaggatttgctatatggccctatataacactaccaatgagatatgttataaggttttaaaagaaaacggttggtctgtactaccgtaccttaaagcaacatggatagatatgatcgaaggattcatgatggaagcttcatggtacaacaatgatgtggttcccaacatggaagaatatgtagaaaacggtgttactactgccggagcgtacatggcgttagtgcacttgtttttcttgattggtcaaggtgttactcaggaatctgttaagctccttatgaaaccataccccaaattgtttagttgttctgggaggatattgagactctgggatgacttgggcactgccaaagaggaacaggagcgaggtgatttggcgagttcaattcaactgttcatgaaagagaataatattaaaagtgatgaggaaggtagaaaggggatactacaacttatccacaacctatggaaggaccttaacagcgaactggtttcgaggaatgcaatgcctttggctataattaaggccgcgtttaatatggcgagggcttcacaggttgtctaccagcatgaagaggactcatatttttcctcagttgataattatgtaaaagca

SEQ ID NO: 961 - DNA, 1593 bp, Nepeta mussinii
atggctgctacaacaaccagtccaaatttggcgcccgtagtccataataacgatcatatgttagaaattgtagaatctactaaaaaacgtgaatatttggttgagaaaatcacagaaaaattaacagaagcaagctcggaaaagttaaaacttattgatgagattcagaggttgggtattggttatcatttcgaggatgtgatcaaatcaataatgcaagtccaatgttctgctttctctaccgaagaagatttgttcactactgctttgagatttaggttattgagacaagctggttttcacgttatacctgaagtgtttacccgttttaaggataagtccggaaactttaaggaatctttaggaggcgatacgctgggattgttgtctctatatgaagcctcccatattggcgttgatggcgagcgtatgttagaggatgctagacaatttacagaaagttacttgaggcaatcgttagccaaattggccccgagattaagaggtgaagtggggcaggcgttagaggtaccaaggcatcatcgaatggtccgtctagaggctcggagatttatacaagaatatgggaaacaatccggccatgatagagatttacttgaattagctattttggattataatcaggtccaagcacaacataatatggaattgaccgaaattgtaaggtggtggaaagagcttggattagttgataaattatctttcgccagagatcgccctttggagtgctttttatggtccgttgggctgcttccagaccccaagtattccaattgtagaatcgaactcgcaaaaaatattgctattttgttggtgattgatgacattttcgatacatacggtaaaatggatgatttaatcatatttacacatgcaatacgtagatgggatcttgaagcaatagaaacattaccagaatatatgaagatatgttacatggccttatacaataccaccaacgaaacatgttatagggttttgaaagacacaggtagatctgtattcccgtattttatttctacgtgggttgacatgattgaaggtttcatggttgaggcaaagtggttcaacggtggaatagctccaaatttagaagaatatatagaaaatggtgtttctactgctggggcttacatggctctggtctatcttttttttttaattggttatggtgtcacggaccaaaatgctagtttgcttattagaaagccctaccctaaactgtttagtgcggctggtcgtatcctacgtctgtgggatgatttgggtacggctaaggaagaagaagagaggggggatctagctagttctatacacttgttcatcaaagaaaagaatctaagtactgaagaagatgccagatctagaattttggaggaaattttcagattgtggaaggatctgaacggggaattaatctcagataataaggttctgccattatctataatcaaggtggctcttgatatggctagaagcagtcaagtagtatataagcatgaaggagataactatttcagtagcgtggacaactacgttgaagccctttttttcactccacttgtctcttca

SEQ ID NO: 962 - DNA, 1593 bp, Nepeta cataria
atggctgcaacgactacttcacctaacttagcacctgtagttcataacaatgaccacatgctggagatagttgaaagtacaaaaaagagggaatatttagtggagaaaataaccgaaaagcttaccgaggcttcatctgagaagctaaagttgatcgatgaaatacagaggttgggaatcggttaccatttcgaggatgttatcaacagcattcttcaagttcagtgctccgcattctctaccgaagaggatttattcacgactgctctcagattcagattgttacggcaggccgggttccatgttaccccagaagtttttacgcgtgttaaagacaaaagcggaaattttaaggaatcgttgggtggtgacacacttggtcttttatctttgtatgaagcttctcatattggagttgatggggaacgtatgttagaggacgcaagacaatttacggaaagttacttgagacaaagcttggctaaactggcgccacgattatgcagcgaagttggacaggctttagaggttccaaggcaccatagaatggtacgcttggaagccagacgttttgtacaagaatacggtaaacagagcggtcatgatcgtgacttgttagagcttgctatcttggattataaccaagttcaagctcagcacaatatggaactaacggaaatagttaggtggtggaaagagttgggtttggtagacaaactctcatttgcgagagataggccattggaatgttttttgtggtcagttggtcttctgccagatccaaagtactcgaattgtcgcattgaattagcaaaaaacatcgcaatacttcttgttatagatgatattttcgacacttatggcaaaatggatgaccttatccttttcactcacgctatacgtaggtgggacttggaggccatggaaacgctgccagaatatatgaaaatttgttacatggcgctgtataatacaacgaatgagacatgttacagagttctcaaagagaccgggcgcacagtatttccttattttaaatccacctggattgacatgattgaaggtttcatggtagaggccaaatggtttaacggtggcatcgagccaaaccttgaagagtacattgaaaatggagtctctacggctggtgcttatatggctttagtgtacctatttttcctgataggtgaaggcgtgactgatcaaaatgcttccctcttaataagaaagccttatccaaaacttttttccgcagctggtagaattttgcgattatgggatgatctgggtacagctaaggaagaagaagagcgaggagatctagcatcgtcgatacatctatttataaaagaaaaaaatctaagtactgaagaagacgctcggtcacgaatactcgaagagatcttcagactatggaaagatttaaatggagaattgatctctgataataaagtcctgccactcagcatcataaaagttgctttagacatggctagatctagccaagtagtttacaagcatgaaggggacacgtatttttcttcagtggacaattacgtggaagccttattcttcaccccattagtaagctcc

SEQ ID NO: 963 - DNA, 1530 bp, Nepeta cataria
atggaatctactaagaagagagaatacttactagaaaaaataactgaaaaattgcaaaagattacggaggcaagtgaaaaactgaagttaatcgatgaaatccaacgtcttggtattggttatcatttcgaagatgttatagataatattttacaggttcaatgcagcgctttcagtactgaggaagatttattcacaactgcacttagatttaggctgttacgacaagctggttttcatgttacacccgaagtatttactagggtgaaagacaagtcaggtaattttaaggaatctattggtggtgatactcctggcttattatcgctttacgaggcttctcatataggtgtagacggtgagaagatgttagaagatgcaaggcaacttactgagttctacctgaggcaatctctggcaaggttggcacctagacctcgtggcgaggtaggacaagccctcgaggtcccgagacatcatcgaatggtcaggttggaagcaagaagattcatcgaagaatatggtaagcaatcaggccatgatcgagatctactggaattggcaatcctcgattacaatcaggtgcaggctcaacataacatggagttaacagaaatcgtcaggtggtggaaagaattaggtttagttgataaactgagctttgctagggaccgcccattggaatgttttttatggagcgttggtttactgccagatccgaagtattccaactgcagaatagaattagcaaaaaatattgcaatattattggtcatcgacgatatatttgatacttacggaaagatggacgacttaattttgttcacacacgcaataaggagatgggatttggaagctatggaaaccttacctgaatacatgaaaatttgttatatggcgttatataatactaccaacgagacttgctatcgtgttttgaaagaaacgggtcgtactgtatttccttactttaagtccacttggatcgatatgatcgaaggtttcatggttgaagcgaagtggttcaacggtggtattgaacccaatttagaagaatatattgagaatggtgtttctacggctggtgcctacatggctttggtatacttattttttttaatcggagaaggagtgacagatcaaaatgcgtcattactcatcagaaagccgtatcctaaactgttcagtgctgcgggcaggattttaagattgtgggatgacttgggtacagcaaaagaggaagaggagagaggcgatttagcatcgtctatacacctattcataaaggaaaagaatttgtctaccgaggaagatgctagaagccgtatactcgaggagatctttagactctggaaagatttgaacggtgaactcatatccgacaacaaagttctcccattatctattatcaaggttgcattggacatggctagatcgagtcaagttgtatataagcacgaaggggatacctatttttcttcggtggacaattatgtggaggcattgttctttacgccactggtttcttcg

SEQ ID NO: 964 - DNA, 1626 bp, Phyla dulcis
atgtgtatgagtagttcggtttcattaccgacggccacgaccagttcatctgtaatcacaggtaatgacgcacttttaaaatatatcagacagccaatggtgattccacttaaagaaaaggaaggtactaaaagacgtgagtacctattggaaaagacagctagagaattgcaaggaactaccgaagccgctgaaaagttaaaatttattgataccattcaaaggctgggtatctcatgttactttgaagacgaaataaatgggatactacaggctgaactttcggataccgaccaattggaggatggtttgtttacgactgccttgaggtttagactgcttcgacattatggttatcaaattgctccagacgtgtttctgaaattcaccgaccagaatggaaaatttaaggaatcattagctgatgacactcaggggctagtttccttatatgaagctagttatatgggtgctaatggtgaaaatatactagaagaagcaatgaaatttactaagacccacttacaagggcgtcaacatgctatgagagaagtcgctgaagccttagaattgccgagacatctcagaatggccagattagaggcacgtagatacattgaacaatatgggacaatgatcggccacgataaagatttgctagaattagtaattttggattacaataatgttcaagctcagcatcaagccgaattagcggagattgcacgttggtggaaggagcttggtttggtcgacaaattaacgttcgccagagacagaccattagaatgttttttatggacagttggacttttgcccgagcctaaatacagcgcttgccgaatcgagcttgcaaagaccattgctattctgctcgtcatcgatgacatcttcgacacgtacggtaaaatggaagaacttgcattgttcaccgaggccattagacgctgggacttggaggctatggaaacattaccagaatacatgaaaatctgttatatggccttgtacaatactactaacgaaatatgttacaaagtcctaaagaaaaacggttggtcagtacttccttatttgcgttatacttggatggatatgattgagggatttatggtagaagcaaaatggttcaatggagggtcagcccctaatttagaggagtatattgaaaatggtgtttcgactgctggcgcctatatggctctggttcatcttttttttcttatcggagaaggtgtctcagctcaaaatgcgcagattttattaaagaaaccatacccaaaacttttcagtgccgcagggagaattttaagactgtgggatgatctaggtacggctaaagaagaagaaggccgcggtgatttggcttcctctatcaggctatttatgaaggaaaaaaacttgacgacggaagaagaaggaagaaatggaattcaagaggaaatttatagcttgtggaaagatcttaacggcgaattgatatctaagggtcgtatgcctttagctatcattaaggttgcactaaatatggcacgtgctagtcaggtcgtttataaacacgatgaagattcatacttctcttgcgtagataactacgtcgaagctttgttcttcactccactgctg

SEQ ID NO: 965 - DNA, 1563 bp, Vitis vinifera
atgtctgaggcagattcatccacaagacgcatgaaagaagtcaaggaacgaacctgggaagcattttatcgcgcttgggattcccgggcggcaatggaaatggttgataccgttgagcgattgggcttgtcttaccattttgaagatgaaatcaatgcattattgcagcgattctgtgattggaacgcaagtgaggacctgtttactacagccctccgattcaggttactaagacaaaatggctttcccactcatagtgatgtctttggtaaatttatggacaagaatggcaagtttaaggaatcgttgacggaagatatttggggcatgctttctctccatgaagctagccatcttggtgcaaagaacgaggaggtcctggctgaagctaaagaattcacaaggatccacttaatacaatcgatgccacatatggaaccccacttttcttctcatgtgggacgtgcattggagttaccacgacatctccgcatggtaagactagaggccagaaattatattggagagtattctagagagtccaatccaaatttggcattccttgagttagctaaattagattttgacatggtgcagtcattgcatcagaaggaacttgccgaaatagtgcgatggtggaaacaactagggttggtcgacaaactagacttcgcacgtgatagaccgatggagtgttttctatggacagtcggcatttttccagatccccgtcatagtagttgtagaattgaactaactaaagccatagctattttgctggttattgatgacatttatgattcatacggtagtttggacgaattggctttatttacagatgcagtaaaaagatgggaccttggagcaatggaccaattgcctgagtacatgaaaatttgttatatggctttatataatactaccaacgacatagcctaccgaattttgaaagagcatggatggagcgtgatcgaagacttaaagaggacatggatggacatttttggtgcattccttgccgaagcatattgtttcaaaggaggacatgtgccatcactagaagaatacttgactaacgctgtgacgacaggcggtacttacatggcattggtccatgcgttcttcctaatgggccagggtgtcaccagggaaaatatggctatgttaaagccatatccaaatatcttttcatgtagcggtaagatcctaagattatgggatgatttaggtacagcaagagaagagcaagaacgtggtgataacgcgtcgtcgattgaatgctacaagagagaacgggaaatggacaccgtattggaggacgaagcctgtcgaaaacatataagacaaatgattcaatctctatgggtcgaacttaatggcgaacttgtggcctcgagtgcgttgcctctctccataattaaggctgcttttaatcttagtcgaacagctcaagtcatttaccaacacggtgatgataacaaaacatcaagtgtagaggatcatgttcaggccttattattcagacctgtttcttccaatggtcacgcccaaatcactatgcac

SEQ ID NO: 966 - DNA, 1641 bp, Catharanthus roseus
atgtcttcttcgagtagctcttctagtagtatgagcttgcctttggccacccctctgatcaaagacaatgaatctctcattaaattcttgaggcaacccttagttttacctcatgaagtggatgatagtacaaaacgacgcgagttgttagaaagaacaagaaaggagttggagctgaatgctgagaagccactggaagcactgaaaatgatagatatcatccagaggctgggtctgtcctatcatttcgaggatgacataaattcaatactaacaggcttctccaatatctcttcacagactcatgaagacttattaacagcgtccctttgttttcgcttgttgcggcataatggacacaaaatcaatccagatatatttcagaagttcatggataataatggaaaatttaaagattcattaaaagacgatacattgggcatgctatccttgtacgaggctagttatctaggggcgaacggagaggagatactcatggaggcgcaagaatttaccaaaacccacttgaagaattctcttccagcaatggcaccatccctatcaaaaaaggtttctcaagctctggaacagccacgtcataggagaatgttgaggttggaggcaaggcgttttatagaggaatatggtgccgaaaacgaccacaatccggatttgctagaattggcaaagcttgactataataaagttcagagcctccaccagatggaactttctgaaattacccgctggtggaaacaattaggtctagttgacaaactcaccttcgccagagatagaccattggaatgttttttgtggacagttggcctattacctgagcccaaatattcgggatgtagaatcgaactagccaagacaatagcaattttgttggtcatagacgatatttttgatacccatggtacattagatgaactcttactatttacaaatgctattaaaagatgggatttggaggctatggaagaccttcctgaatacatgagaatctgttacatggcattatataataccactaacgaaatctgctataaggtcttgaaggagaatggttggtcggtgttaccatatttaaaagctacatggattgacatgattgaaggtttcatggttgaggcagaatggttcaactcggattacgttccaaatatggaagaatacgtagaaaatggagttcgcacggctggttcttatatggcactagtacatctcttcttcttgataggtcagggtgtcactgaagataacgttaaacttctcattaaaccttatcccaaattgtttagtagttctggaagaatcttgagattatgggatgatttgggcacagcaaaagaagaacaagaacgcggggatcttgcgagtagcattcaattgtttatgagagagaaagagattaagagcgaagaagaaggcagaaaaggtatattggagataatcgaaaacttatggaaggagctcaatggtgaattggtttatagagaggaaatgccattggcaataatcaaaaccgcattcaatatggcacgtgcaagtcaggtagtctaccagcatgaggaggatacttatttctcaagtgttgataattatgttaaagctttgttcttcactccatgtttc

SEQ ID NO: 967 - DNA, 1578 bp, Olea europaea
atggcggaaaatggcgcaatgtacaattatatcagacagcctgttattgttactccagaagttgacgatggtacgaaacacagtgaactagtggaaagaaccagacgtgaacttcagagatctaccaaaccggtggaaactttaaaactaattgataaccttcaaagattaggtatcgcctactattttgaagacgacatcaacgccatcttggatcaattctcagacggacttccggatgaagatttgtttacgacggcgctgtgttttagactgctaagagatcaaagattacaaacgggaagcgatgtatttttaaagtttatggaaaagaatatgaaatttaaggaacatcttgctcaggatactatcggcctcgtttctctgtacgaagcaagttcaatgggtgcaaacggagaagaaattttgtctgaagcaaaggagttcacagaaatgcacttaagacaaagcatgccacagttggccccacaattaaggagacaggtatcatctgctctggaattgccacgtcatttgcgtatggctaggctagaagctcggagatacatagaagaatatgggaatgaaagtgatcatgatccagctctattggaattggctagactagattacaacaaggtacagttgcagcatcagatggagttagcagaaattactagatggtggaagcaactgggtttagtcgagaaactttcatttgctagagatagacctctggaatgctttctgtggacggttggtttattgccagagcctaaatactcaagctgtagaattgagttagcgaaaactatagcaatcctactggtcatagacgatatatttgatacttacggaaaaatggaagaattggtcttatttacagaggcaattcaaaggtgggatctagatgagcttgaaactcttcccccatatatgagaatctgttatatggctctatacaataccacaaacgagatctgctataagatcttaaaagaatacgggttttgtgttctaccatatttgaaatcaacgtggatcgacatgattgaaggcttcatggtcgaggctaattggttcaatggtgggcacggtccaaacttggaagaatatattgagaacggcgtgagtactgcaggggcatatatggccctagttcatctgttttttctaatcggagagggtgtgacaaatgaaaacatagcaaagctattgagaaagccctaccccaaattgttctcggctgccggaagaatcttaaggttgtgggatgatttaggcacagctaaagaagaagaggaaaggggtgaccttgcatcatgtatgcaaatacttatgagagaaaaaaacatcgattgtgaaaacgaaggcagaaactacatattgaaggcaatcaacggtttatggaaggaccttaacgacgaacttatatctcctaatgcgatgccattagctataacaaaggttgcccttaatatggcaagagcctttgaggtcgtttacaaacacgaggaggattcctacttttcctctgttgataattacgttcaggctttatttttcacacctatcaat

SEQ ID NO: 968 - DNA, 1512 bp, Valeriana officinalis
atgataatggagttggttgaggctacaagacgtacattaagaaatgaatcctctgacagtactgaaaaaatgagactaattgactcactacaaaggctaggtctaaatcatcactttgaacaagatataaaagaaatgttgcaagattttgccaacgaacacaagaataccaaccaagatctttttactaccagtctgagatttagactgcttaggcataatggtttcaacgtcaccccagacgtgtttaataaatttaccgaagaaaatggtaagtttaaagaaagtttaggagaagacacaataggcattttgtcactgtatgaggctagctacttaggtggtaagggcgaagagatcttaagtgaagctatgaaattctctgaatctaagctaagggaaagctctgggcacgtcgcaccccatatcagaagacaaatttttcaaagcctagaactaccgcgacacttgcgtatggcccgccttgaatctaggcgctatatagaagaagactatagcaatgaaatcggggctgactcttcccttttggaacttgcaaagctggacttcaatagcgttcaagcgttacaccaaatggaactcacagaaatcagtagatggtggaagcaactgggtctgtccgataagctgccttttgcaagagacagaccgcttgaatgctttctatggaccgtcggcctgttacccgaaccaaaatacagcggttgcaggatcgaattggccaaaacgattgcggtgttactagtcatcgacgacatcttcgatacttatggttcctacgaccagttaatcctatttaccaacgcaatccgtagatgggatcttgacgcgatggacgaattgccagaatacatgaagatatgctatatggccttatataatacaacgaacgaaatctgctacaaagttcttaaggagaatggctggtctgttctaccataccttaaaagaacctggatcgacatggtagagggttttatgctggaggctaagtggctaaactctggtgaacaaccgaacctggaagcctacatcgaaaatggtgtaacgacagccggttcatatatggctttagtccacttattttttttaatcggtgatggtgttaatgacgagaatgtcaagttacttctagatccctacccgaagttattttcttcggccggtcgtattttgcgtttgtgggacgacctaggaacagctaaggaggaacaagaaagaggagatgtgtcttctagtatacaattgtatatgaaggaaaagaacgtacgttctgaaagtgagggaagacaaggtattgttgaaatcatatataatttatggaaagatatgaatggtgaattgattggttcaaatgctttacctcaagctattattgaaacaagttttaatatggcaagaacttctcaggttgtctatcaacacgaagacgatacatatttttcttccgtcgataactacgtacagagcctatttttcacgccagtgtca

SEQ ID NO: 969 - DNA, 1512 bp, Valeriana officinalis
atgattatggaattggtggaagcaacaaggagaacgcttcgaaacgaatcttcagattctacggagaagatgagattaatagattcgttacaacgtttggggttaaaccaccattttgaacaagacatcaaggaaatgttacaagacttcgctaacgaacataaaaacactaatcaggacttatttacgacttcactgcgttttagacttctaagacataatggttttaacgtaacaccagatgtgttcaacaagttcaccgaagagaatgggaagttcaaggaatccctaggtgaggatactatcggaatcctgtctttatacgaggcatcatatcttggtggaaaaggtgaagaaatactttcagaggccatgaaattctctgaatcaaaacttcgtgagtcttctggtcatgtagcgccacatattagaagacagatatttcaatcattggagctgccccgccatttgaggatggctagattggagtcaagaaggtacatcgaagaagattactcgaatgaaattggtgctgactcatcgttattggagttggccaagctggattttaatagcgtacaggccttacaccaaatggagcttacggaaatttcaaggtggtggaaacaattgggattatcggataagttaccattcgcaagagacagaccacttgaatgttttttgtggactgttggtctcttaccagaaccaaaatactcgggatgtaggatcgaacttgcaaagactattgctgtgttactagtcattgatgacatatttgatacatacggatcttatgatcagcttattttgtttacaaatgctatcaggaggtgggatttagatgctatggatgagctaccggaatacatgaagatttgttatatggctctctataatacaacaaatgaaatttgttataaagtcttgaaagaaaacggttggtccgttctgccttacttgaagcggacgtggatcgatatggttgagggttttatgctagaagccaaatggttgaacagtggagaacaacctaacttagaagcctatatcgaaaatggggttacgacagccggtagctatatggctcttgttcatttattcttccttatcggcgatggtgttaatgacgaaaatgtcaagttattgctggatccatacccaaaattattctcttcagcaggaaggattctgagattatgggatgacttaggcactgccaaagaagaacaggaacgaggtgatgttagttcttctatacaactatatatgaaggagaagaacgtgagaagtgaaagcgaaggcagacaaggtatagttgaaataatttataatctttggaaagacatgaacggtgagctgataggtagcaacgctctaccccaggctattattgagacgtcttttaacatggctagaacctcacaggttgtttaccagcatgaagacgacacatacttttcatcggttgataattatgtacaatcattgtttttcacccctgtatcg

SEQ ID NO: 970 - DNA, 1521 bp, Valeriana officinalis
atgatcatggaattggttgaagctactagacgtacattaagaaacgaatcttctgattcgacggaaaagatgagattaatcgattctttacaaagacttggtctcaatcatcattttgaacaagatataaaagaaatgttgcaagacttcgctaacgagcacaaaaacacaaaccaggacctattcactacctctttaagatttagactgctaagacataacggcttcaatgtgacgcccgacgtgtttaacaagtttaccgaagaaaatggtaagtttaaagaatcattgggggaggacacgataggtattttgtcgctgtacgaagcatcctatctaggcggtaaaggtgaagaaattctgagtgaagctatgaaattctcggaaagtaaattgagagaatcaagcggtcatgtggcgccccatattcgcaggcaaatcttccagtctttagagttacctcgacatttgcgtatggcaaggttagaatccaggagatatattgaagaagactactccaatgagattggcgccgactcatcgctgttggaattagcaaagttggacttcaattcagtgcaagcactacaccaaatggaattaacagagatctctagatggtggaaacaattgggcttgagtgataaattgcctttcgctagggataggccgttggagtgctttctatggacagttggtttgttgcccgaacctaaatattcgggttgccggattgagctagcaaaaacaatagctgttctactggtcatcgatgacatttttgatacttatggaagttacgaccagctaatactctttaccaacgctatcaggaggtgggatctagacgcaatggatgaattacctgagtatatgaaaatctgctatatggcattatataacacgactaacgaaatttgttataaggttcttaaggagaatggttggagcgttttgccttatcttgagagaacttggatagacatggtggaaggtttcatgttagaagcaaaatggcttaattctggtgagcaaccaaatttggaggcatacattgaaaatggagtaactacagccggctcgtacatggccttggtgcacttattttttcttattggtgacggtgtaaatgatgaaaatgttaagttgttgttagatccttatcctaagctattctcatcagctggaagaattctaagattgtgggatgacttgggaacagcaaaagaggaacaagaaagaggtgacgtgtcttctagcatacagctttatatgaaggagaagaatgtacgttcagaatcggaaggcagagaaggcatagtggaaatcatctataatttgtggaaggatatgaatggtgagctcataggatcgaatgcattgccacaagcaattatagaaacaagcttcaacatggcccgaacaagtcaggttgtttaccaacatgaagatgatacatacttttcatctgttgacaactacgtccagtcactgttctttacacccgtttctgtaagcgtt

SEQ ID NO: 971 - DNA, 1617 bp, Pogostemon cablin
atgatgtctacgtcgtctcttccggttggcaacgaagctctgcttaagtacataagacagcccgttgttttaccaaccgaggaggatgaatctataaagcggagagattatttgttggaaaagactgccaggcgtttaaggacgagcaccggatccgtagagaagttgaaattgattgatactatccaaagactaggtattgattattatttggaagatgatattaacgttgttttgcgcaacgaatactataacggtagatcttcagaagaggatttgtttaccaccgctttgagatttaggttactgagacataatgggtttcaaatctcctctgacgtgtttatgaaatttaaggacaaaaacggtaagttcaagaaatggattgcagaagacacaattggtctcttgtccctgtacgaggctagctatatgggtgctcatggcgaaaaaatactagaagaggccatggagttttctagaagtttattgaaaagatctttgccacaattgccacccaaactgcatggacaagtggctcaagcgttagaattgcctagacatttacgtatggcaagattggaagcaaggcgatttgtccaacaatatgcaaagcaatctgattgtgatagggatctgttaaacttagctaccttggattataacaaggttcaattacaacatcaatttgagctcgcggagattacaaggtggtggcaacaattgggcttggtcgaaaagctaacatttgctcgtgatcgtcctttggaatgtttcctttggacagttggcttgcttcccgaacctaggtattcaacttgtaggatcgaaatggccaagacaatcgctatacttttggttatagatgatatttttgacacatacggtaaaatggacgaactgttactatttactcaggcaatccggcggtgggacctagaagcaatggacattttacccgaatacatgaaaatttgttatatggccttatacaatactacaaatgaaatttgttacaaggtattaaagttgaacggttggtcagtcttaagttacctaaaaagtacttggattgatatgattgaaggatttatggttgaagccaagtggttaaatggaggaggggcccccaacctggaggaatacctcgagaatggcgtgtctacagccggcgcatatatggctttagtacacctcttttttctaataggggagggagtcaatgatcaaaatgcccccctcttgacaaaaaaaccataccctaaactatttagtgcagctggcagaatactgaggctatgggacgatttgggtacagctaaggaggaacaagaacgcggagacgtcgcatcgtcaattgaattcgtgatgagggaaaaagaggttgagtcggaagaggaaggacgcaggtacattcttggcgaaatttacgagctgtggaaggatctaaacggtgaacttatgtccaaaaatggtatgcccctagcaattattaaagttgcgttaaatatggcaagagcatcccaagtagtatataaacatgaggaagacacatacttttcgtccgttgataactatgtggaggctttattttttactcccctacctagctcaatt

SEQ ID NO: 972 - DNA, 1629 bp, Picrorhiza kurrooa
atgtctagtgcagcacccaatgttactcaagtcgtcgtcggcgctaatgatgcattgttgcaatatacacatcaaccaatgttgataccctctgaggtcgacgcagatactgaaagaagagattatttacttgaaaaagcgcgtcaagaattgtcaagaactactaagccaactgataagttgaaattgattgatatgattcaacgactcggtattggattttacttggaagacgatataaatgcaattttgaggacccaattctcagtaaatgttattgacgaagaagacttgtctgctactggtcttcgttttagaatgttaagacagaattcgtttcccatttccagtgatatatttaaacgattccaagatcagaatgagaaatttgatgaaaccctcacaaatgatactttgggagtgattgaattggtaagaagtatcattcacggtgaaccgaagggggaagaaatattagaggaagctatggaattctctaagactcgtctgaaaaggtctttgtcctctttacctgcacaaataaaggcagacgtcggccaggctttggagctgccaactcatttacgtatggcaagactcgaggctagaaggttcatagaacagtacgcaactcagtcagaccataatccaattttattagaattagcaactcttgactataatcacgtacagtcacaacatcaaatggaattggtggaaattactcgctggtggaagcagcttggtctagtagatcaattgtcgttcgctcgtgacaggccactagaatgctttctatggacagttggattattgccagaacctaagtatagctcctgtagaattgaactagccaaaaccatcgccgttcttttagttattgatgatatattcgatacttatggcaagatggatgacttaattctatttacagatgcaattcaacgttgggacctaggtgctatggaatcattgcctgagtatatgaaaatctgttatatggcgttatataatttgactaacgaaatatgttataaagtcctgaaagaaaacggttggactgtattaccctacttgaaatcttcttggattgatatgattgaaggtttcatggtggaagcgaaatggtttaatggtggttgcgctccaaatttggaagaatacgttgagaatggtgtttcgacagcaggatcttacatggctttagtacatttattctttttaattggagaaggtgttactgaacaaaacgcacaactgctaatgaaaaaaccatatccaaaagctttctcatctgcaggtcgaatattaagactgtgggatgatttgggtacagcgaaagaagagcaagaaagaggagacctagccagttcgattaacttgtttatgaaagaaagaaacctcgcgacagaagaagaaggaagagagtgcatattagaagatatctatggttattggaaggacctaaacggagaattagtgtcccagaaagaaatgcctctagcaatcattaaagttgctttaaatatggcaagagcatctcaagttgtttataagcatgaggaggatagctactttagtaatgtagataattacgtgcaggcattgttattcacccctttaattatc

SEQ ID NO: 973 - DNA, 1635 bp, Gentiana rigescens
atgtgtatgcccatccctacaagtactatgtcacaacctattgctacccctctaataaaggataatgaatcgctattgagatatttacggcaaccaatggtgttacctcacgaactagatgatgatacaaagagaagggaacttgtagaaagaactagacgcgagttacagtccatgagtaagcccttggaggctatgaaattaattgacactttggataggttagggatcgcctatcattttgaagatgatattaatcaatctctaacaaggtttagctctggtcaaccaaatgaagatttgttgactacatctttaagattcagattattacggcataacggtcattccatctcatctgaaatctttggtaagttcttagttcaaaatggaaaattcgaggaaagtttaggcgaggaggatatattaggactcttgtccttatatgaggcttcctatatgggtggtggcgaagaaaagatattgatggaagctatggaattttctgaagctcacttaaagtcaagcattgcaaagttaacacctcaattgtcgcgtcaagttgcacagagccttgaattacctagacacagaaggatggctcgattggaagcaaggcgctacatagaagaatacggtaagttcgagaacaattataatcctgacttattggaattagcaaagctggactacaataaggttcaaagtctgcatcaaatggaactatccgagatcactagatggtggaagcaactgggacttgtcgacaagttgccattcgctagagacaggccattagagtgtttcttgtggactgttggtctgatgccagaaccgaaatattcgggttgcagaatagagttagctaagactattgctattttactcgttatagatgacatttttgatacccacggtactatcgatgaactggtgctatttacaaatgctataagacgatgggatttgcaggcaatcgaagagttgccagagtacatgcgtatttgctatatggctctttataataccactaatgaaatttcatataaaatccttaaagaaaatggatggagtgtaaggccctatttgaaagaaacatggatcgacatggttgatggtttcatgatggaagcttcttggttcacaaacggacaggttcccaaaatggaagaatatcttgaaaacggtgttacaacagcgggatcttacatggcattagtacactgtttctttctgatcggtaagggtgtttctgaagaatctgtcaaacttttaatgaacccttacccaaaattgttttctaatgccggtcgaattttgcgtctttgggatgacttaggaacagctaaagaggaacaggaaaggggagatcttgcttcgtctattgttctatttatgaaagaaaagaatattacgtctgatgaagaggccagagaatcgatcttgaagttgatacacaatctgtggaaagaaatgaacggagaattagtctcaagaaatgctctgcccttagaaataaaaaaagttgcattcaacatggcacgtgcgtcacaagtggtgtatcaacatgaagaagactcttactttagctctgtcgacaattacgttaaagcattgttttttactcctttgata

SEQ ID NO: 974 - DNA, 1623 bp, Camptotheca acuminata
atgtgtacaacgcttccgagtccggcaaccagcactgcaacaatcggtgatacagattctttgttgaagtcacaaaggcaatttactgtgtatttaccggctcatgaagctgacaaagatagaaaaattgaagaaatcatggaaaaaacccaaggggagctggaaaaaacaagtgatccgacaagcgttatgaaatttattgatacgcttgaacgattaggaattgcttatcactttgaagaagaaataaattccttgttgcaaggttttttagcaaatggttattcccattacccacaagatttgtttaccactgcacttaggtttaggctactcagacacaacggatatcatatatcagccgatgtttttcaaaagttcgttgataagaatgggaaattcaaagaatcattacgcgaggatactcaaggtatgttgtctttatacgaagcctcctatctgggagctaacggcgaagatattctatctcaagccatggaattcacagaaacgcatttcaaacaatcaattcctctaatggccgctgttccacaattagagcaggccttggaacttcccagacacctaaggatggcaagattagaagctaggcgttttattgaagaatatattagggaatccgatcactcctcagcactactggaattggctaaattggattataacaaggtgcagttgctgcatcaaagcgaactcaatgaaatatctagatggtggaaacaactgggtttggtggaaaacttaggatttggtcgcgacaggccgctcgaatgctttctgtggactgtaggtatcttgcctgaaccaaagtactctggatgtagaatcgaattaacaaaaaccatagccgtcctgttggttttggatgatatttttgacagctttggtacccttgatgagttggtccgttttacacatgcaattagaagatgggatttgtctgcaatggaacagctcccggaatacatgaaagtgtgctacatggctttatataacacaactaacgaaatcggctataaaattttaaaagaacatggttggaacgttgtaccatatctcaagagaacatggattgacatgatcgaaggctttcaagctgaagctaactggtgttcttctgggtacgttcctagtctagaagaatatatagaaaatggcgtgacaacggcaggctcatacatggcattagtccatttgttttttctcatgggccagggtgtaacggacgaaactatcgggatgctagaaccataccctaaatttttcagctccagtggaagaattttaaggctttgggatgacttgggtactgcttctgaagagcaagaaagaggtgatattgcatcttctattgagctatttatgagagagaaggacttatcatcacagggtgaagctagaaagtatgtaaagcaagttatttattcactatggaaagaattgaatggggaacttatggcgtcaaaggcgatgcccttgcccttgattaaggcggcatttaacatggccagaacgtcgcaagtgatatatcaacatggggacgataattcttttcctagtgttgatcaatgcgttcagagtctattctttactcccattctt

SEQ ID NO: 975 - DNA, 1605 bp, Osmanthus fragrans
atgtctccaagcgttactcctctaatacccacagaaaacgacgcattatataattacatacgccaaccagttattgttacgcctgaggtggatgaggggaccaagcatagagagctgcttgaaaagacacgaagagaattgcagaggtctacaaaacccgtcgaaacccttaaattgattgataaattgcagagattaggtattgcttattactttgaggatgatattaatgcgattctggaccgtttctccgattgtctacctaatgaagatttgtttacaaccgctctgtgttttcgtcttctgcgggataatggatacaaaacagactcagatgtgtttttaaaatttatggaaaagaataaaaaattcaaaggccacttagctcaagatacaattggtctgttgtctctttatgaggcctcatatatgggagccaacggtgaagaaattttgtcagaagctaaggagtttacagagattcaccttcgtcaatcaatgcctcgccttgctccacaattgcgtaggcaggtgggttctgctttggaactaccaaggcatcttaggatggcccgtttagaagctcgcagatacattgaggaatatgccaccgagtcagaacacgatccagcgctcctagaacttgccagattagattataataaggtccaactacaacaccaaatggaatccacagaaatatctagatggtggaaacagctgggtcttgtggaaaaattgtcttttgccagagaccgctttttggagtgctttttgtggactgtagggctgcttcctgaacctaaatactcttcatgcagaattgaactggcaaagaccattgctattttgttggtaattgatgacatatttgatacatatggtaaaatggaagaactagttttgtttacggaagcaattcaacggtgggatttggatgagctagaaaccttaccaccctatatgagaatctgttacatggctttgtataataccacaaatgaaatctgctacaagattcttaaagcatacgggttctgtgtcctaccttacctaaaatcaacctggattgatatgatcgaaggctatatggtggaagcaaactggtttaatggaggacacggaccaaatttagaagaatatatagagaacggcgtcagtacggtgggtgcctatatggcacttgtacatttgttttttctgatcggtgaaggtgtgactaacgaaaatataacaaaactattaaggaaaccgtaccctaaattgttttctacggctggacgtatcttacggttgtgggatgatttaggtaccgcaaaagaggaagaggaacgtggggacttggcgtcgtgtatgcaaattttgatgcgcgaaaaaaacatttattgtgaaaacgaaggtaggaagtacattcttaaagctataaattctctttggaaggatttaaatgatgaattgatctctccaaacgcgatgcctttagcaataacaaaggtagcccttaacatggcaagggcgagcgaggtagcctacaaacatgaagaagattcatatttctcttcggtatacaactacgtgcaagcactattttttacccctatcaat

SEQ ID NO: 976 - DNA, 1521 bp, Artificial Sequence
  source: /note="Description of Artificial Sequence: Synthetic polynucleotide"
atgattatggaattagtcgaagcgaccaggaggactcttagaaatgaatcctcggattccacagaaaagatgagattaatagattctcttcagaggctaggtttgaaccatcatttcgagcaagacattaaagaaatgttgcaagatttcgctaatgaacacaaaaacacaaatcaggatctgttcacgacaagtttaagatttagattgttacggcataatggtttcaatgtgactcccgacgtttttaacaaattcaccgaagaaaatggtaaatttaaggagtctttaggcgaagacactatcggtattctgtcgctgtacgaagcttcctatctcgggggtaagggggaagagattttaagcgaagctatgaaatttagcgagagtaagctaagagagtcttctggccatgttgctccacatattcgcagacaaatttttcagagccttgagctacctagacatttgagaatggctagattggagagccggcgttatatagaagaagattacagcaatgaaatcggagctgattcaagcctcttggagctagcaaaattagatttcaattctgttcaagctcttcatcaaatggaacttaccgaaatcagtagatggtggaaacaattaggcctatcggataagttgccattcgctagggatagacctttggaatgcttcctgtggaccgtcggactattaccagaacccaaatactcaggttgtagaatagagttagccaagacgatcgccgtgttactcgttatcgatgacatcttcgatacttatggttcctatgatcagttgatcttgttcactaacgccataaggcgttgggacctagatgcaatggacgagcttcctgagtatatgaaaatttgttatatggccttatataacacaacaaatgaaatctgttataaagttttaaaagagaatggatggtctgtattgccctaccttgaaaggacgtggattgatatggtcgagggttttatgctagaagctaagtggttgaattctggcgagcaacccaaccttgaagcttatatagagaatggagtaactactgctggatcgtatatggcattagtgcatttattctttctcataggcgatggagttaacgatgagaatgtaaagctgttgttagacccttatcctaaattattcagttccgccggacgcatattaaggttgtgggacgatttaggtactgcaaaagaggagcaggaaaggggtgacgtatcatctagtattcaactttatatgaaagagaagaatgtgaggtcagaatcagaaggaagggaaggcatagtcgaaataatttataatctatggaaggacatgaacggtgaactaattggatcgaacgctttgccacaagctattattgagactagttttaatatggctaggacctcacaagttgtctaccaacatgaagacgatacttactttagttcagttgataattacgtccaaagtttgttcttcactccggtttctgtgtcagta

SEQ ID NO: 977 - DNA, 1575 bp, Phaseolus lunatus
atgacacagaaggttccatctcgtacaaaccctatgatgacatctttggaacagatcaaaattagaattcaggaagtcctacttaagtcaaatgactctctagagactcttaagttgattgacaatatccaacgcctgggcatcgagcatcacttcgaagaagaaattaacttgcaactaggaaaggtaggtaattgtaataactcccaagatttatctgcggctgctctacagttcagactactaagacataatggttggtctaccagtagcgatgtcttcaataactttttggacaaatctggtaattttaaagaatcattcaatagagatatttggggtatgttgtctctatatgaagcatcttactttggagcacaaggagaagaggttttgcaacacgcaatggaattttctagggcccacttacatctgtcactacctttgttatcacctgaagttggtcgggttattgttgaagctttgaagttgcctagacatcaaagaatgtcacgtttggaagcaaaaaattacatggtccagtattcaactgaatcgtcacaaataccagcattattagaatttgctcgcatagagtacgataccgtgcaaagtatgcatcagtctgaattggctgaaatatccagatggtggaagaatttgggacttatcgaaaggttaggcttcgggagagatggtcccagagaatgctttttatggatgttgggtgtatttccagaaccgtgttattcccactgtaggatcgaactggccaaagcaatctgtattctacaggttctggacgatatgttcgacacatatggaacgcttgatgagctaatcttattcacagaagctgttcaaaggtgggacttggatgctatggaaaaattacctgagtatatgaagatatgttacatggccctgtacaataccacacatgaaatagcctatcgtattcaaaaagatcacggtcagactgtggtggcttgcttaaaaaggacgtggatcgacctattggaagcttacttaattgaagctaagtggtttaacaacaaatatgtaccaactttcggtgaatatttagataatggtgttatatcatctggctcttgtctagcgcttgttcatgcaacttttctaattggtgataacctctcaaaggaaacgattagcatgatgtccccttaccctagactattcagttgttcgggagagatactaagattatgggatgatttaggcacaagtaaagaggaacagaagagaggtgataacgcttgttctatacagtgcctaatgaaagaaaattatattctcgatgaaacttttgcaagaaaacatatcaaacaagtactaggcaacttatggcctgaattgaatgggttagtaatggccactactacacttcctttttctattagaaaggcgtctttaaacatggctcggacgagtcaattcatttatcaacatggtgatgatcagactatgcctaccgtgaacgatttagtaaaggagttgctttttacaccttctagtaagagcggcgaagagtcggacacgtattgcgtggta

SEQ ID NO: 978 - DNA, 1587 bp, Unknown
  source: /note="Description of Unknown: GES sequence"
atgatatccactatcagtcaaccaactaggaaagaacccgcaacgaccaaaccagagattatggaggaattgcatgaaggaacacgaaaggagctacttactagctccagccctatagctactatgaagttgattgacagtatccaaaggctaggtgtaggatactattttgaagaagaaattaatacccttttagataggtttttggacttggaaactactgaggatttactagcgactgcactaagatttagattacttcgtgataactgtttcccagctcatagcgatgtttttggaaaatttatgaataaggatgggaagtttaaggaatcgcttagaaaggatgtatggggtttgttatctctgtacgaagctagctatttggggacgaaggatgaagttgaattggttgaagctatggaattcacaaagacgtgcttggaagaacagagtattccactcatggctcataagctttcaagacatgttagtcaagccttagatcttcccagacacttgaggatgcccaggttagaggctaggaactatatccatgagtactctttggaatcgaataacagtccgccgttgctggaactagccaagcttgagttcaatgctgtacaatctctgcatcagaaagagttaattgaaattgtgagatggtggaaacagctaggtttagtagacaagttaggcttcgctagagaccgacctctggaatgttatttatggacagttggtattttcccggagccatacaattccacatgcagaattgaattgacaaaaacgatagcaatcttactagtaattgatgacatcttcgatacgtacggctcacttccagatttgatattgtttacagaggccgttagacgatgggatctgaatgctatggagtcgttgccggaatacatgaagatatgttatatggctttatacaatactactaacgacattggtttcatgattttgaagcggcatggattatcaattgtcccacacttgaaaagaacttggattgacatgtttgaagcttttcttacagaggcaaagtggtttaattctgggtacgtaccaacgttagaagaatacctggacaacggcgttaccacaggtggtacgtatatggctttagttcacagttttttcttaatgggtcagggtgtgaacaaagaaacagtcacaatgatggaaccctaccctgatttatttagccttagtggtagaattctgagattatgggatgacctaggcacggcacgtgaggagcaggaaagaggcgatgttgcatgttcaatagaatgcctgatgagagagaaaagaataagttgcgacgatgaaggcaggaaacaagttagacaactgattagatcattatggaccgaattgaatggtgaattaatagcgccttctgccatgccgttgtcgattattaatgcttcattgaatttagcaagaactgctcaggtcgtttatcaacatggcgacgacaagaagggaagtagtgttgacaaccaggtccaagcactaatctatattcctatctcttttccaaaacgacgtgatttgaagttactg

SEQ ID NO: 979 - DNA, 1539 bp, Vigna angularis
atggctatgaaacaaaataaattatccattaagtcagtggctttcagggacaaagtaccaattcagatcgatcccggtaaaaaaaaactagagcaagttaagaggagttctcaagagaccttgctaaattccagcgaccccacaaagactttgaaaattattgataatattcaaagattaggtatcggccatcatttcgaagaagaaattaacgtcaaattaggaaaagtggctgactgcgattttagccaagatttgtgctcaactgccctacaatttagattattgcgtcataacggttgccacgccagtagtgatgtgttcaagaagttcctggaccattccggtaattttaaggaatcgatcacaacagatatatggggtatgctatctatgtatgaagcatcctatctcggtgcaaaaggagaagaagttctacaacaagcgatggattttagctctgctcacctacaacagtctttacctttattgtcgccggacgtaggcaaccatgttgtaagggctctgacactgcctagacatcttagaatgtcaagattagaagcaaggaattacattgaagaatactcccaagtctcttctaagatgccatacttgctagagatggcgaaaatcgataacgcaatggtccagtcaatgcaccagaaagagttggccgatatctcgaggtggtggaaggacctcggattagtcgaaagattgggttttgctagggacaaacccgccgagtgctttctttggacggtgggtgtttttccggaaccttgctattctaattgtcgaattgaactagccaagacgatctgcatactattagttatggacgatatttttgatacgtacggaacctcggatgagttggttctatttactgaagctataaagagatgggacttagatgccatggaacagttgcctgaatatatgaagatttcatatctggctttgtacaacacaattcaggagattgcttgccgaatccaaatggagcacggccaaactgtcttatcctgccttaaacggacgtggatcgacattttcgaagcttttctgaaagaagctaaatggttttcgaataagtatgttcctacttttgaagaatacttagcaaatggcgtaatatcttcgggttcttatatggcattagttcatgccacttttctgataggagatggtatatcgaaagaaactatctctttgatgaatccttatcctcgactattttcctgctccggggaaatcctgagactatgggatgacctggggactagcagagaagaacaggaaagaggcgataacgcatgcagtctacaatgcttaatgactgaaaataacataagcgacgaaattgtcgctagaaagcagattagaggttttatcagaaatttatggcctgagttgaactccttggctctaacaactgcttcattacccttttccgtaataaaagcttcattgaatatggccagaacctcccaggtaatatatcaaaatggtgacgatcaaaacacttttact

SEQ ID NO: 980 - DNA, 1398 bp, Vitis vinifera
atgtctgaagcggattcaagtacccggagaatgaaagaagttaaggaacgtacttgggaagctttctatagagcttgggactcccgtgctgctatggaaatggtggacacagtggaaaggttggggttaagctatcattttgaagatgaaataaacgctttattacaacgcttttgcgattggaacgcttccgaagatctgttcacgactgcattgcgcttcagattgttaaggcagaacggtttccctacacactccgcttctgatgtgtttggtaagtttatggataagaacggtaagttcaaagaatctttaacagaagatatctgggggatgttatctctacacgaagctagccatctgggtgccaaaaacgaagaagtcttagccgaagcgaaggaatttacacgtatccacctcattcagagtatgccgcacatggaaccacacttctcatctcatgttggaagagctttggaactaccaagacatctaagaatggcgcgttggtggaaacagttgggtctagttgataaactagacttcgctagggatagaccaatggagtgtttcttgtggactgtgggtatttttcccgatcctcgtcatagttcatgcagaatcgagctgaccaaggcgatagcaatattattggttatagatgacatctatgattcctacggttccttagacgaattagccttattcactgacgctctgccagagtacatgaaaatttgttacatggcactatataacactacaaacgatattgcttatagaattttgaaagaacatggttggtccgtcatagaagatttgaagagaacgtggatggacatttttggtgcatttttagccgaagcttactgtttcaagggcggtcatgttccctcccttgaggaatacttaacaaatgcagtaacaactggcggcacatacatggctctagttcatgctttctttttaatgggtcaaggtgttacaagagagaatatggcaatgcttaaaccctatccaaacatattttcctgtagcggtaaaatacttagactatgggacgacttaggtactgccagagtaggtgataacgctagctcaattgaatgctataaaagagaaagagaaagagagatggataccgtcttggaagatgaagcctgtcgtaagcatataagacaaatgatccaatctctatgggtggagctgaatggcgaattggttgcttcttcggcccttcctctgagtattatcaaagctgcctttaatctgtccaggaccgcacaggttatctaccaacatggtgacgacaacaagacaagttcggttgaagaccatgttcaagcattattgtttcggccagtttcgtcaaacggtcatgcgcagattactatgcat

SEQ ID NO: 981 - DNA, 1611 bp, Coffea arabica
atgtgtatgccaactcctacggcaacccaacctattgctacaccattaatacgcgacaatgagtctttgttgaaatacctcagacaaccttccgtacttccacatgaggtcgatgattctcgcaaggaattgttgggtagaactcgaagacaattaagaagcacctctgagcctctaaaagccatgaacttaatagatacgttgcaaagattgggtttagcataccatttcgaagacgatatgaatgctattttgtcacaattgagttcctcgggtcaatcagatggtgatttactcacaacagctttaaggttcaggttgttgcgccataatggacacaagattgttcaaaagtttatggataaaaatggaaagtttaaagattcgctaaaagaagacactatgggcttactttctttatatgaggctagtcatttagctgccaacggcgaagacatacttcttgaagctatggagctaacagaggctcatttaaaacaatctttaccctcattacctacccagttggcaaggaaggtctcatccgccttggagttaccacgccacagacgtatggcccgcctggaagcccgcaggtacatccaagagtacagtgaggagattggacacgaccctaatttgcttgaattggccaaattagattataacaaggtccaatccttacaccaaatggaattgacagagatttccaggtggtggaagcaattggggctagttgataaacttacctttgcaagggatagacccctcgagtgttttttatggacagtaggtatcctgcccgaaccaaagtattctaattgtaggattgaattagcaaagacaatcgcaatattattggtcattgacgacatttttgacactcatggtactatagatgaattggtcctttttacaaacgcaattaggagatgggatttagaagctatggaaggactccccgagtatatgagaatttgctacatggcattatacaataccacaaacgaaatttgttataagattcttaaagaaaacggatggtctgtccttccctatctcaaagcaacgtggatcgatatgatcgaaggttttatgctagaagcatcctggtacaataatggtcaggtgcctaacatggaagaatatgtagaaaatggtgttacaactgctggtgcatatatggcaatggtccatttattcttcctgattgggcaaggtgtgactgaagagaacgtcaaattgcttatgaagccatatccaaaactattttcatgttccggcaggatccttagattatgggatgatctcggtactgcgaaagaggagcaagaacgcggagacctggcctccagtatccaattgttcatgagggaaaataatattacttgtgacgaagaaggcagaaagagaattttgcaattaatcgataatctctggaaagatttaaactgggaactggtgtcaagagatgcaatgccattggccataattaaggccgcatttaacatggcaaggagctctcaggtagtttatcagcatgaagaagaatcctatttcagttcagtcgataattacgtggaaagtctgttctttactccaatcataaat

SEQ ID NO: 982 - DNA, 1623 bp, Coffea canephora
atgtgtatgcctacgcctaccgctacccaaccgatagcgacgccgttaatacgtgataatgagtcgctcttgaaatatttaagacagccttctgtgttgccccacgaagtagatgatgggaggaaagagctgttaggaaggactaggagagaacttcgaagtacttcagaacctttaaaagccatgaacctaatcgacactttacaaagattaggtcttgcgtatcacttcgaagacgatatgaacgctatactttcccaactatcatcgagtggtcagtcggacggtgatctattgacaactgcattaaggtttcgactcttaagacataacggtcataagatttcttccgacatattccaaaagttcatggataagaatggtaagtttaaggactcgctaaaggaagataccatgggcttattatcactttatgaagcatcacatgtaggtgcaaatggtgacgatttattattagaggctatggaattcacggaagctcacctaaagcaaagcctgccttcattaccaactcaattagctaggaaggtctcttcagcattggagctgcctcgtcacagaaggatggcgcgcctagaggcacgaagatacattcaagagtattcagaagaaatcggtcatgatcccaacctacttgaactcgcaaaacttgattacaataaagtacaaagccttcatcaaatggagctaactgaaatttcaagatggtggaaacagttaggtctagtagataaattgacttttgcaagagacaggccactggagtgttttttgtggactgttggaattcttcctgaaccaaagtattcaaactgtcgaatagagctagctaagactatagcaatcctcttagtaatcgatgatatattcgatactcatggaacaatcgatgaattggtcctttttacaaacgctatcagaagatgggacttggaagccatggaaggtttgccagaatatatgagaatctgctatatggccctttataatactactaacgagatttgttataagatcctaaaagagaatgggtggtcagtgttgccttatctaaaggccacctggatcgacatgattgaaggttttatgttagaagcttcttggtacaataatggtcaagttcccaatatggaagaatacgttgaaaatggagtgactaccgcaggtgcatacatggctatggtccatttgttcttcttgattggtcagggtgttactgaagaaaatgttaagctactaatgaagccataccctaaactattctcttgttctggtaggatccttagattgtgggatgatctcggtacagcaaaggaggaacaggagcgtggagatctagccagcagcatacagctgtttatgcgtgaaaataatattacctgcgacgaagaaggacgcaagagaatactacagctaatcgataacttatggaaagacctcaattgggaattggtatcgagagacgctatgcccttagcaattattaaagcagcttttaatatggctagaagttctcaagtggtatatcagcatgaagaagaatcgtatttctcatctgtggataattatgttgagtcccttttcttcacacctataataaac

SEQ ID NO: 983 - DNA, 1587 bp, Glycine soja
atggcgttttcagaaaaggttccgagtcaaacatactatcccgggatgaaggatttcgatcaagtcaagcgtaaaagtcaagaggcactcttgaactcatcagatagtttgcgaacattagaaatcattgatacaatacagagacttggaatcgaacatcattttgagaaagaaatcaacttacaacttggcagaataggcgactggaatgctgccgaggatttattcgctacgtctcttcagttcagattattaaggcactatggttggcccacttgttctgacgttttcaataaatttcttgatcaatcaggtaactttaaagaatccgtaactcgtgatatttggggtatgctctccttatatgaagcatcctatctaggtgccaagggtgaagaggttctccaacaggcgatggattatagtagagcccatttatgccaatcattgagtgatctttctcctaaggtcggttctattgtggtcgaagcattgaagctgcctaggcatcttcgcatgggtagattagaagctaagaacttcatggtcgaatactcacaagcttcaaatcaaatccctgccttgcttgaattggcacggttggattatgatatgattcaatccatgcatcaaaaagagcttgcagaaatttctaggtggtggaaagaacttggcctgattgaacggttaggtttcggcagggatggtccgagggaatgttttctatgggttttgggtatattccccgaaccaaggtactctaattgtcgtatcgaattggcaaaggctatttgcattttgcaggttttagatgatatgttcgacacctatggcactcttgatgagttgatattattcactaaagccataaaacgctgggacttggatgttatggaacaactgccagagtacatgaagatttgctatatggctttgtataacactacacacgaaatcgcttataaaatccaaaaggaccacgggcaaactgttgtcgcatgtttgaaaaggacatggattgatttaattgaggcttatttgaaggaggctaaatggtttaataataaatatgtgcctacgtttcaacaatacttggacaatggtgtcatttcatcgggttcgtatttggctctagttcatgcatcttttttaatcggcgatgacttttccaaggaaacaatttccatgatgaatccaccctatcctcgccttttctcatgcagcggtgaaattttacgcttgtgggacgaccttggaaccagcagagatgaacaggaaaggggagacaatgcttgttcaattcagtgtttaatgaccgaaaacaatatcagcgacgagaacgtagccagacgtcatattcgcaaactgatcaagaacttgtggccggaattaaatggtttgaccatgataacgacaactttgccactgtcagtcatgcgtgcgagtttgaatatggccaggacctcacaagtaatataccaacacggtgattatcaatcaatgttgactgttgacgatcatgttcaagcattgttgcttacgccatcaatcaattatcaagatgagagcgacattaaccacgtcatt

SEQ ID NO: 984 - DNA, 1554 bp, Glycine soja
atggctttcaacgacaacaaagttccttctcagattgatcttcgtactaacaattttgaacaagtaaaaaggaatagtcagatggccctattgaattcttctgacccaattaaaatattaaaaatgattgataccattcaaagattgggtatagaacaccattttaaagaggaaataaatgttcaacttggtaaagtcggggattgggacgtaactcaggacttgtttggtacagcactacagttcagactgcagaggcataacggttggccttcttgtagcgatgtatttaaaaaatttttagacaagagtgggacttttaaagagagcattacaaacgatatctggggtatgttatccctgtatgaagcttcatacctgggggctaaaggtgaagaagttttacagcaagccatggacttttccaaagcgcacttacatcagagtctcccccacttaagtcctgagctacgtaagttagttgctaaagctttaacattacctcgtcatctgagaatgggtagacttgaagcaagaaattacatggaaaagtactcccaagcaactaatcagattcctgctctcatggagctggccaaattggattttgctatggtgcagtcaatgcatcagaaagaattagctgaaattagtagatggtggaaaaatttgggactagtagagagattaggatttgcacgggatagacctgctgaatgtttcttatggactgttggaactttcccagaacctagatattccaactgtcgaatcgaattaacaaagactatttgtatcttattggtgatggatgacattttcgacacatacggtactttagaagaactagtcctgttcacggaagctataaaaaggtgggatttagacgctatggaacagcttccagaatatatgaaaatatgttatatggccttgtttaatactacccacgagatcgcttacaagatacaaaaagaacatggtcaaaccgttgttgcttgcttgaagcgaacttggatcgatatttttgaagcctttttaaaagaagcaaaatggttcaataatggatatatacctacttttaaagaatatttagacaacggtgtgatctcttctggatcttacatggctctagtccatgcaacgtttttaattggtgattcgttatctaaggaaacaatttcgataatgaagccttaccctcggcttttttcctgttccggcgaaatactcaggctatgggatgatttaggtacatccagagaagaacaagaaagaggggataacgcttgctctattcaatgtctaatgacagaaaataacttatctgatgagaatgtagctagaaaacatattagacagttaattcaaaatttgtggcctgaattgaacggcctggccatgacaacaaccgccctgccatctagtgtaatgaaggcttctttaaatatggctagaacggcccaagttatataccaacatggcgacgatcagaatacgttcacggttgacgattatgtcaaaactttgattttaaccccaagctcgaattac

SEQ ID NO: 985 - DNA, 1473 bp, Vigna angularis
atgacacaaactattcctacgatgacttccttggaacagcttaaaatcaaatcccaggaagtactgcttgattcatctgactcgttgagaacgttaaaattaattgacactattcagagacttggtatcgatcaccactttgaggaagagattaacctgcagttaggtagggttgctgattgcaataatgctcaagacctgttcgcaacagctttgcaattcaggttattgaggcacaatgggtggtccacaagctccgatgtgtttaataaatttttggacaaatcaggtaattttaaagaatccgtaaccggggatgtctggggcatgctgtcattgcatgaagcctcgtatttaggtgcagaaggtgaagaagtactacagcatgcgatggaatgttcgagagctcatttacaccagtcacttccccatctgtcgcccgaagttggaagagttgttgttgaagccctaaagttaccgaggcatcaacgcatggttagattggaagctaaaaactacatggtacagtattctaaagaaagttctcaaattcctgcacttctggagctagcgagattagattacgatatggttcaatccatgcaccaaaaagaactagcggagatatccagatggtggaaggacctcggattgatcgaacgccttggttttggaagggatgggcctagggaatgttttttgtgggcattaggtgtcttcccagagccacggcactccaattgtagaatagaactagctaaagctatttgcatcttacaggttattgatgacatgttcgatacatatggtacattagacgaattgatattgtttactgaagctgttcagagatgggatcttgatgccatggaaaagctgccagaatacatgaaaatttgctatatggctttatataatacgacccatgaaatcgcttacagaatacagagagatcatggtcaaacagtggttgcttcccttaagagaacatggatagacctgctggaagcctacttaaaagaagcaaagtggtttaacgataagtatgtgccagcttttgaagaatacttagacaacggcgtaatctcctccggctcctgtttagctttagtacatgcgaccgtgttaattggtgagaatttgagtcgggagaccatcagtttgatgtcaccttaccctagattgttcacatgttcgggagaaattttaagactatgggacgacttgggaacttcgaaacatatcaggagattgttgggtaacttgtggcctgaattgaacggactagccatggccacaacaacgcttccatcggccgtaaccaaagccagcttcaatatggcaagaactagtcaattcatatatcagcatggtgatgatcaacaaatgcccacagtcgatgatttagtacaagcattattgtttactccatccgacaaatatggtgaagaatccgacattaactgtgtcgta

SEQ ID NO: 986 - DNA, 1299 bp, Glycine max
atggcattcaacgataataaagtaccctctcaaatcgatctgcgtactaataattttgaacaagtaaagaggaattcacaaatggcattattaaatagttctgatcctatcaaaatactgaagatgatcgacacgatccagcgtctgggcatcgaacatcattttaaggaggaaataaacgttcaattaggtaaattgggtgactgggatgtaacacaagatttgtttgggaccgctctacaattccgtttgcaacggcataatggctggccaagttgtagcgacgtttttaaaaaatttttggacaagtcgggtaccttcaaagagagtataacgaacgacatttggggtatgctaagtttatatgaagcctcatacctcggagcaaagggtgaagaagtgctgcaacaagcaatggatttctcaaaagctcatcttcaccagagcctcccacatttatctccagagctccgaaaacttgttgcaaaggcacttacgttgcctagacatttgcgaatgggaagattagaagccagaaattatatggaaaaatatagccaagctactaaccaaattcccgccctgatggaattagctaaattggattttgcaatggtgcagtcaatgcatcagaaggagttagctgaaatttctcgatggtggaagaacttgggtcttgtcgagaggcttggttttgctagagatagacccgcagaatgctttctgtggactgttggtacctttccagagccgagatactcaaactgtcggattgaattaactaaaaccatttgtattctgctagttatggatgacattttcgacacttatggtacacttgaagaattagtattatttacggaagcaataaagagatgggatttagatgccatggaacagttaccagaatatatgaaaatctgttatatggctttattcaatacgactcatgagatagcttacaaaatacaaaaggaacatggtcaaaccgtggttgcttgtcttaaacgtacttggattgatatttttgaagcatttctcaaagaagccaaatggttcaataatggctatatcccaacattcaaggaatatttagacaatggtgttatctcctcagggtcgtatatggcgctagtgcatgctaccttcttaataggtgactcactgtccaaagagactattagtattatgaaaccatatcctaggctcttttcatgcagtggcgaaatacttaggttatgggatgatctcgggacatcaagagtattgattcatttggacactcacttatttccatct

SEQ ID NO: 987 - DNA, 1626 bp, Cajanus cajan
atgtctagtatgttccaacctcgcaatttaagcttaaaaacaagcaggcctcccatgatctataataatctttcaattaaaagcattgctttcagagataaggtgccttcccaaactgacccttctacgagaaacctagaacaggttaaaagaagatcacaagaattactgttgaatagcagagatccaattaagaccttgaagatcatcgacaacatacaaagactaggtatcggacatcactttgaagaagagattaacgtgcagctcggaagagtaggtgactgggacgttacccaagacttattggcaacagcactccaatttagactattgaggcacaacggatggccagcacggtccgatgcgtttaagaagtttctagacaacactgggaacttccaggaatccatcacaaacgatatccgcgcgatgttaagtttatacgaagcttcttatttaggtgcgaaaggcgaggaaatcttacagcaagcaatggatttttctactgctcatcttcatcaatctttgccgcatttatcaccagaattgggaagaattgtagcgcgcagtttgactctaccgcgtcatttacgaatggctcgattagaagccaaaaactacatggaagagtactcgcaagcttcatcccaaattcccagtttactagagctagcaaaattggaccatgttatggtccaaatgatgcatcaaaaggagcttgccgaaatttcaggatggtggaaaaaattaggtttagttgaacgtctaggttttgcacgggatagaccagaagaatgctttctttggacggttggagtcttccccgaaccatattattcaacctgtagaatcgaactaaccaaaactatttgcatccttttggtcatggatgatatttttgatacatatggaactcttgacgagctgattttgtttacaaaagctattaagagatgggaccttgatgcaatggagcaattaccagaatatatgaaaatttgttacattgctctgtataatactacccacgagatcgcaaataaaattgaaaaagctcacggggaatcggttgttgcctgcctcaagaggacatggacagatatattcgaagcgttcctgaaggaggccaaatggttcaacaacaaatacatccctacgtttcgcgaatacctagataacggagtgatttcatctggttcttatatggctatggtacatgcgacgtttctagtaggggacggtctttctaaagaaactatcagcatgatgaagccataccctcgactcttttcctgttccggcgaaatactaagactgtgggatgatctgggtacgtcacgggaagaacaagagagaggcgataatgcttgttcaatccagtgcttcatgactgaaaacaatatttccgatgaaaacgtagctaggaaacatattagagaacttatccgaaatttatggcccgaattaaacgggttagcaatgactactagtgcccttcctctttctgtaatgaaagcctcgttgaacatggctagaacggctcaagtgatataccaacatggagatgaacaaaatgccttcacggttgatgactacgtaaagacattattatttacccagcac

SEQ ID NO: 988 - DNA, 1878 bp, Cajanus cajan
atgttgcaaacactccgaccaggtaccatgagaacaaaattatctatcaaaagcatttccttaccagatcaatttgggcccagagttatctatacacgtccggtcggatttttaccgatcaatcatgaatttggtttgagcagttcctatttatatagtgccaatagaatcttcacagatcaatctcgagtctggtcggtttttgagttattcattcttgcgcaaagcgatttttacagatcaataacgtccttggttttcgagttatttattttggcccaaagcgaattttgtagacaatcacgcgtttgtttaagggttatctatacacatccaatcgagttactgcctacaatcacttctttatacggtaagaagagtctggagcaattaaaaagatcctcacaagaagcattattgaatacttctgattctttgcgtactttaaagacaattgacactatccaaaggttgggtatagaacatcattttaaggaagagataaatctacaactaggtagactaactaactgggaaccagtagaaaacttgtttgctactgctcttcaatttagactgttaagacacaacggttggcctactagaagcgatgtgttcaataagttccttgataaatcgggtaacttcaaagagtctgttaccaaagatatttgggggatgttgtctttgtacgaatcttcatatttaggtacaaaggatgaagaagttctgcaacaagcgatggattttagcagagcccatctgcatagaagcttgccatatttatcgttggaagttaaaaacatcgttgggggagctttgatgttgccaagacatctgaggatggcccggcttgaagctaagaattacatggtggagtgtagaaagactagctcacagattccagatttgctgaaattagccaggttggatttcgatattagccaatcaatgcatcaaaaagaactggctgaaattagtagatggtggaaaaatctgggattagtggaatctatcggttttgggagagataaaccaggtgaatgttttctttgggtacttggtattttacctgagccctgttatagcaattgtcgtattgaattagcaaaagcaataagcgtactacaagtgatggacgatatgttcgacacacatggtaagttggatgaactggttccttttaccatggcaatcagaagatgggatttggacgcgatggaacagcttcctgaatacatgaaaatttgttatatggcattgtataacacaatccatgaaatagcatacagaatccagaaagagcatggcaaaactgtcataacctgcatcaaaagaacggtgcatattttcgaagcatatttaaaagaagccaaatggtttaacaacaaatatgtaccaacattcagggaatacttagacaatggagtaatttcaagtgcttcttttatggcccttgtccactctacattattgatcggtgataacctaagcgaaaagacaatatctatgatgattccatacccacgaattttctcctgcagcggggaaattctaagattatgggacgacttagggacaagtagggatgaacagaaaagaggagataatgcctgctcaatacaatgtttaatggctgaaaataacataagtgacgagaatgtagctagaaaacacattaggaaattaattgggaatttgtggcttgaattgaatggcctggcacttactacgactgacttcccactgagtgttgcaaggacatctcttaatatggcgagagctgcacaagccatatatcagcatggagatgatcaaagctcattgacggtagatgaccaagttcaagctctgctgtttacaccttccgccaactat

SEQ ID NO: 989 - DNA, 1563 bp, Vitis vinifera
atgagcgaagcggacagctcaactagaagaatgaaggaagttaaggagagaacttgggaggcgttctatagagcttgggattcaagagccgctatggaaatggttgatactgtggaaagattggggttgagctatcatttcgaggatgaaatcaatgctctgctccaacggttctgtgactggaatgctagcgaagatttgttcaccacagctctaagattcaggctactgagacaaaatggttttccaacccattcagatgtttttggtaaattcatggataagaatggaaaatttaaagagtcattaacagaagacattcgtggaatgttgagtttacatgaagctagtcatttgggtgcaaaaaatgaagaggttctggccgaagctaaggaatttacaaggatacacttgatacaatccatgcctcatatggaaccccatttcagttcacatgttggccgtgctctcgagcttcctcgtcatttgagaatggttagactagaagctcgaaactatattggtgagtactcacgtgaatccaatccgaacttagcgttcctagagttggcaaagcttgattttgacatggtgcagagtttacaccaaaaagaacttgctgaaattttgagatggtggaagcagttaggccttgtggataaactcgatttcgcaagggatcgcccgatggagtgctttttgtggaccgttggaatctttcctgatccacgacactcatcctgtcgaattgagttaacgaaagcgatagctattctgttagtaatagatgacatttacgattcctatggttcactagatgaattagccctttttacggacgcagtgaaaagatgggatttgggagccatggaccaattacctgaatacatgaaaatatgttacatggctttatacaatacaaccaacgacattgcctacagaattttaaaagaacacggttggtcggttattgagcatcttaagaggacatggatggatatcttcggagcgtttttagcagaagcctattgctttaaagggggccacgtaccatcattggaggaatatttaactaatgctgtaaccacaggagggacctacatggctctggtacatgccttctttcttatgggtcaaggagtgacacgagaaaatatggccatgctaaagccatatcctaatatttttagttgttctgggaagatattaagactttgggatgaccttggtaccgccagggaggagcaagaaagaggggataatgcctcgtccatagagtgttacaagagagagagggaaatggatacggtccttgaagatgaggcttgcagaaagcatataagacagatgatccagtccttgtgggttgaacttaatggtgaactagttgctagttcagctttgcctctgtccataattaaagccgcttttaatctttcccgtactgctcaagtcatctaccagcatggcgacgataataagacatcctcagttgaagatcatgttcaagctttactatttagacctgttagctctaatggtcatgcgcagattacaatgcac

SEQ ID NO: 990 - DNA, 1569 bp, Vitis vinifera
atgagcgaagctgatagctctacgagacgcatgaaggaagtaaaggagcgaacttgggaagctttttaccgtgcttgggattcgcgtgccgctatggaaatggttgacacagttgaacgtttgggactgtcatatcattttgaagacgaaatcaatgcattgttacagaggttttgtgactggaacgcctccgaagatttatttacaacagctttaagatttagactactacgtcaaaatggctttccaacccactcggatgtctttggtaaatttatggacaagaatggtaagtttaaagaatcgttaacagaggacatctggggaatgttatctttgcacgaagcttcacatctcggagctaaaaatgaggaggtattagctgaagccaaagagtttaccagaatacatttaatccagtcaatgccgcacatggaacctcatttttcgagtcatgtaggaagagcattggaactgccaaggcatctccgtatggttaggcttgaagccagaaattatattggggagtacagcagggaatcgaacccgaatttggcctttctagagctggcaaagttagatttcgacatggtacaatccttgcaccaaaaggaattggccgagattgttagatggtggaaacaattgggattggttgataaactggatttcgcccgtgatcgaccaatggaatgtttcttatggacggtcggtatattcccagatccaagacattctagctgtagaattgaactgactaaggccatcgcgattctactagtgatcgacgacgtctacgattcttatggtagtctcgatgaattggcgctttttactgatgccgtaaaaagatgggacttgggcgcaatggatcagctccctgaatatatgaaaatttgttacatggcattatacaatactaccaatgatatcgcgtacaggatacttaaagaacatggttggtccgttattgaagacttgaagaggacatggatggacattttcggtgcctttctagctgaagcccattgttttaaggggggacacgtgccttctttggaagaatatttaaataacgcggttactacagggggaacctatatggccttagttcacgcattttttttaactcgtcagggggttactcgagaaaatatggccatgttaaaaccatatcccaatattttttcatgttcagggaagatactaagattgtgggatgatctgggtaccgctagagaagaacaggaaaggggtgataacgcgtcctctatagaatgttataagagggaaagagagcgagaaatggatacagtcttagatgacgaagcctgtagaaaacatattaggcaaatgatacaatcactatgggtggaattgaacggagaacttgtggctagttctgctttacccttatctatcataaaggctgcttttaatttaagtagaacggcacaagtaatttatcagcacggggatgacaataaaacttcttcggtcgaagatcatgtacaagctttactttttagacctgtatctagtaacggtcatgctcaaattactatgcat

SEQ ID NO: 991 - DNA, 1554 bp, Glycine max
atggcattcaacgataacaaggttccctcccaaattgacctgagaacgaacaactttgagcaggtcaaaagaaattctcaaatggctttactgaactcttcggacccaatcaaaatactaaagatgatagatacgattcaaaggttagggatagaacatcatttcaaagaagaaataaatgtccagttgggcaaattaggtgattgggacgtgactcaggaccttttcggtactgcattgcaatttagattgcagagacacaatggctggccatcttgcagcgatgtttttaagaaattccttgataagtcaggtacctttaaagaatctataaccaatgatatatgggggatgttgtcactatatgaagcaagctatctgggtgcaaaaggagaagaagtcctacagcaggctatggatttttctaaagcacacctgcatcaaagcttgcctcacttgtcgcccgaactcagaaaattggtagctaaggctctcacattaccaagacatttaaggatgggtagattggaagcacgcaattatatggagaagtactctcaagcaaccaaccaaattccagcattgatggaacttgctaaattagattttgcaatggtgcaatcgatgcatcagaaggagcttgcagaaatatcgagatggtggaaaaatttaggtctagtagagagattagggtttgcccgagatcgtcctgcagaatgctttttgtggacagttggcaccttccctgagcctagatattcaaactgtagaatcgaactaacaaaaactatttgtatcttacttgttatggatgatatttttgatacttacggcactttagaagaactcgtcctttttactgaagctattaagagatgggatctcgacgcaatggaacagttgcctgaatacatgaaaatatgctacatggcattatttaatacaacacacgagatagcgtataaaatccaaaaggaacacggtcaaactgttgtcgcctgtttgaaaagaacttggatcgatatattcgaagcttttttaaaagaagcaaaatggtttaacaatggttatatccccactttcaaggagtatttagataacggagtcatatccagtggcagctatatggccttagttcacgctacctttttgattggtgattcactaagcaaggagacaatctccatcatgaaaccatatccaagattattttcgtgttctggtgaaattctaagactttgggacgacttaggtaccagtcgtgaagaacaagagaggggtgataatgcatgcagtatccagtgtttgatgaccgaaaataacttgagtgatgaaaatgttgctagaaagcatataaggcagttgatacaaaacttgtggccagaacttaatggtctagcaatgactactacagcgttgccatcctcggttatgaaggcatccctgaacatggcacgcactgcccaagtcatttaccaacacggtgacgatcagaatacatttacggtagatgattatgttaagacattaatcttaactccttccagtaattat

SEQ ID NO: 992 - DNA, 1443 bp, Lupinus angustifolius
atgtgctctactaaatccttggagcaagtaaagagaaaaatacaagagaccctgttgaattctgatagacttggaactttgaagataattgattctattcaacatcttggaattggccatcatttcgaagaagaaattaatgcgctgctgggtcgtgtccttgattatgacacggcacatgatttgtttgccacgtcattacacttcaggctattaagacataacggatttcctacatcatctgacatctttaaaaaattctgtgataaatcaggctactttaaagagtcattatcgaaagatatctggggcatgttgtccttgtatgaagcgtcatatttgggtgccgaaggagaagagttgttacataaagctatggatttctcaaaggtccatttgcataattccatttcacagctaggcccacaagtatctatgcatatagctaggagtcttattttacctagacatttaaaaatggctaaactcgaagccaagaactacattcatgaatactcccacgcctcaaatcaaatcccagccttgttggaattggccaagctggattacgatatggcccagtctttacatcaaagggagcttgccgaaatttgtcgtcaagctacattactcttatggtggaaagaattgggtttagttggtcgtctgggattcggtagggatcgtccagctgagtgtttcctatggacattgggtatctttccagaacctagctattctaattgtcgcatcgagttaaccaagactatctgtatcctattggtaatggacgatattttcgatacatacgggtcccttgatgatttgatccttttcactgacgccataaggcgtatccaaaaggaacacggcgttaccgttgttgctcatctaaaacgtacatggattgatatattcgaggcatttctcgaggaagctaagtggtttaataaaggttatatgccaacatttagagagtatttaaacaacggtgttatttcagccggttcatatatggcgatggtacatgctacctttctaataggcgacggtaattcaaaggaaaatatctctatgatgaagccctaccctaggttattttcatgttctggtgaaatcttgagattatgggatgacttaggcacttcaactgaagaacaagagcgaggcgataatgcgtgctctatacagtgtcatatgcgggagaataacatttccgatgagaacgaggctagaaaacatattcgcgagttcataggtaaattatggcaagaattgaatggtatcgccatgaacactaatctgccctggagcattgttaaggcttcattaaacatggctaggacagctcaggtgatttatcaacacggcgatgataaatcgacttatagcgttgatgaatacgttcaaacgctgctatttactccatcacccagaaattca

SEQ ID NO: 993 - DNA, 1635 bp, Handroanthus impetiginosus
atgtgctccggtgtcgcacccacatctacgacaccaattcgtattaattcatcactacaaagcactattcctatctctcctaaattgaagcagcaacaattaagaaaggttgacttggaatacactaagacgaatgaggaactgcgcgaaaagactagaggaaccctgcagaaggctttagatcctatggcagccatgaagttgatcgataccttgcaatggttgggaatatcataccattatgaagaagagattgacttctggttgggtaagctatctcaatgggacgcagatgatgatgaccttcacgctacagctttaagattcagactattacgccaaaatgctagaccggtttcttctgatgtatttaaaaaattccgtgtaaatggcaaattccggaagtccatttcggaagataaagagggtcttctaaatctatatgaagcgtcatgtctgggtaccaatggagaagatatcttgagtgaagctgctaagtttaccgaaaatgaactgaaactttcaagcgcaaatggcatattgcctaaacatatttcaagacgtgtgggaagagctttggaattgccaagacacatgagaatggaaagattggaatctcggttatacatagatgagtacaatattcaagagaaccatagtcttctcttattagaacaagcaaaggctgactataatgaagttcagcttttatatcagagtgagctagcagaaatgtctagatggtggaagcaattgggcctagtcgagaaattaacattcgctcgtgatagacctatggaatgtttcctgtggacagtggggattttccctgagccaaagtactcatctttacgagtagatcttgcgaagactgttgcaattcttttagttatagatgacatattcgatacatacggaaccatcaacgaattgtctcttttcaaaagcgccatccaaagatgggacttggatgcgattgaacaactgccacagtacatgaaaatttgttatatggcactatataatactacaaatgaaatcgcatataaagttcttagagaacagggcagaaatatccttcctttcttggaaaaagcatggattgatgccattgaagcatttatgatagaggcagaatggttcaataacggccatacacctagggttgaggattatttggagaatggcgtaactacgtctggtgcttacatggccctagttcatgcctttttcttgatgggcgagggtttgactattgaaaacgtaaaattgatggcgaaaccctatccgaaattgttttctaactcggggagaattttgcggctgtgggatgatctaggcacagcgaaggaagagcaagaaaaaggtgataatgcctcatcaatttctcttttaatgaaagaaaaaaatatggcacatgaagatgaggctagagcatataccatgaaactaatccacaatttatggaaggaccttaacacagaactattgggcagtaacatgttgccattgccgataatccgggcctgtttcaacatgagcaggacatcgcaggtgatatatcaacatcaagaagacagttactttagtagtgttgataaattcgttgatttgattctattcaaaccaatagcg

SEQ ID NO: 994 - DNA, 1635 bp, Handroanthus impetiginosus
atgtgcagtggagtagctccaaccagcaccacacccatcaggattaactcctcgttacaatctaccattccaatttcacctaaactaaaacaacagcaattaagaaaggtcgatttagaatatacgaagactaacgaggagttaagagagaaaacccgaggcactttgcaaaaagcactagatcctatggccgctatgaaactaattgatactctccaatggctggggatcagttatcattacgaagaagagatagacttttggctggggaagttgtctcaatgggatgcagatgatgacgatttgcatgcaactgccctacgttttaggttactaagacagaacgctagaccagtttcaagtgatgtgttcaagaagtttagagtaaatggtaaatttaggaaaagtatcagcgaggacaaggaaggcttactaaatttgtatgaagcaagttgcttaggaacaaacggtgaagatattctatcggaagccgcaaagtttactgaaaatgagttgaaattgtcgagcgccaatggtatcttacctaaacatataagccgcagagtcggcagagccttagaactgccgaggcatatgagaatggagcgtttggaaagtagactctacatagatgaatataacattcaagaaaatcattctctgttactcttagaacaagctaaagcagattacaatgaggtacaattattgtaccagtccgaattagctgagatgtcaagatggtggaaacagttaggtttggttgaaaaattgacattcgctagagacagacctatggaatgttttttgtggacggtcggtatctttccagaacctaagtacagtagtttacgagttgacttggctaaaactgtagcgatactgctggttattgatgatatatttgatacctatggtacaattaatgagctgtctcttttcaaaagcgcaatacaaaggtgggatcttaatgctatcgaacaattaccacagtacatgaaaatttgttatatggccctatacaatacgacaaatgaaatcgcatataaggtacttcgtgaacagggtaggaatatattacctttcctggaaaaagcttggatcgatgcaattgaagcttttatgattgaagctgagtggtttaataatggtcacactccaagggtcgaagactacttagagaacggtgtgactacatctggagcttatatggccttagttcacgccttctttcttatgggagagggtctgaccattgaaaacgttaagttaatggcaaaaccataccctaaattgttttcaaattcgggcagaatcttaagattatgggacgaccttgggacagctaaagaagagcaagaaaagggagacaatgcatcctcaataagcctattaatgaaagagaagaatatggttcatgaggacgaggccagggcatatacgatgaaactgatacataacctttggaaagacctgaatacagagttgttaggttctaatattttacccttgcctattatcagagcttgtttcaatatgtcccgtacgtcacaggtcatttatcaacatcaagaagacagctatttttcttcggtcgataaattcgtcgatttgatacttttcaagccaatcgct

SEQ ID NO: 995 - DNA, 1473 bp, Lactuca sativa
atggctctgatgaccgactctaaccctataatccttatggaactcgtcgataagattcagagacttggcttgggatgcacattcgaagaggacataaacaagataatgaagtatttggtgcagggacatccaaatgatgatttatacaccgtttcattaaggttcaggcttttgagacataatggactacatgtaaaccccgatgtgttcggttcgtttatggatgcaaatggcaagttcaaggaatcattaagcgaagacatcgaagcacttctatccttgtacgaagcttcctatatgggtgcagatggcgaagacattctttcagaagcaagagaatttaccactcggcatcttaagaaatctgtatttaagctaaccccattactgagaaataaggttcttcaatctctaaaacttccaagacatttaaggatggaacgtttagaagctcgtatgtacatcgaagaatacggtaacgagcaagaccatataccaatattattggagctcgctaagctggaatataatgaaatccaaatacttcaccaaatggaaatttctgaaattacaaggtggtggaaacacttaggtctcaccgataaacttccgtttgcaagagaccgtccattggagtgttttttgtggaccgtcgggcttcttccagaaagaaaatattctaccaaaagaattgaggttgcaaagacaatcagcatccttctagttatcgatgatatatttgacacctatggttcttacgatgatttggttcttttcacaaaagcgattcaaagatgggatatgcaggagatcgagcagttacctgaatatatgaagatctgttatatggccttgtgtaacacaactaacgaaatttgctacgaaattctcaaagaacacgggttaaatgtattgccattcttgagaaagacttggattgaaatggtggaagcctttatggttgaggcagagtgggtgaaacgaggtacagagcctaacttgaaggattacatagaaaatggagtaaagactgcaggtacgtatatggccttggtgcatttgttcttcttaataggtgaaggcgtgacccccgaaaatatgcgtactttaacagacagttatccatcattcttcagtatctctggtaccattctccggttatgggatgatttagggacttcaaaagaagagcaggaaaggggagatgtcgcatcgtccattcaactgctgatgaaagaaaaaaatattacatgtgaggaggagggtaggaaatacattctacaattcatcgattcgagttggaaagaattgaataagactttggtggttccaaatacactaccgattagtataattaggatagcccttaatatggctagggcgtcacaagtggtctaccaacacgaagaatctagctattttagtagagttgacaatcatgtcaaaagtttgttttttgctcctatccaaata

SEQ ID NO: 996 - DNA, 1599 bp, Parasponia andersonii
atgtctatgcagtcgtcgaagccagagacgcaacaccatgacagtctcctgaagagtttgctcttgcaacatggtgttgtaacagaccatgatgatagttcctctaccaaaagcactagtgaggaacattttgtcaaagtgcaaaaagccctgaggaagccttccactcaaaggacaaaaatgcggttgattgattcaatacaaagattaggtgtcggacaccattttgaagaaatcaaacagatcttggagggattcagcgatcttaactcctctgaggacaatctttttgatactgctcttagatttagattgttaagacataatggtttacccacgtcctctgacgtttttgaccaattcattaacaaggaaggtgaattcaaggaatcgctttctcaagacacctgtggcatgctttcgttatatgaagcctcttatcttggtgctaaaggtgaagataaacttcataaagctatggaattcactagatctcatctgaaacaatctatgtcctccgttagcccggaattacaaacacaagtagcgaaagcgttagaattgccaaggcacctaaggatggctactttggaagccaggaattacattgatgaatattcacaggaatctaaccacaactcggcgctcctagcattagccaagttagaattcaatgaactacaaagtttgcataaaagggagcttacagaaattatcagatggtggaagcagctgggccttgtagataagttagggtttggcagagatcgtccctgcgagtgctttctatggaccgtcggtattttgccagaagcctcttactcaagcattcgtgtagaactggcaaaaacgatttctattttgttggttattgatgacatttacgatacctatggcagcttagacgaattagttctgtttaacgaggcgattaggagatgggagctgggagctatggatatgttgcttgaatatatgaaaatatgctacatggctttgtataatacaactaatgaaattggttaccgtgttttgaaggaacatggttggtgtattactgaacatttgaagagaacctggatcgatatatttgaggctttcctgacagaagctgaatggtttaataaaaaacatacccctacattagaaccatatttaactaatggagtgacatcaggtggctcatacatggccctggttcactcttttttcttgatcggtcatgacttgacagatgaaaccattagtttgatgcagccctatccagagctcttttcttgctctggaaagattttgagactatgggatgatttaggcacggcaaaagaagaacaggagcgcggtgatgttgccagtagtattgaatgttatatgagagaaaaaaacatcgagtttgaggacgaggctagaaagcacatacgagaacttataagaagtttgtggatggaattgaacggggaattacgagcgtcctctgcactgccgcgcagtataacgaaggcttgcatcgatctggcaaggacggctcaggttatatatgatcaaagttttttcaacgtagaagatcacgttcaaagcttgttcttcagaccatataat

SEQ ID NO: 997 - DNA, 1635 bp, Trema orientalis
atgtgtcagactggttcgccattaagcatgcaaagttcaaagccagaaactcaacaccatgacagcttactcaaaagtctactcttgcaacatggagtagttgcggatcaccatgatagttcaaacacaaaatcgacctctgaggaactgtttgtgaaggtccaaaaagttttgaggaagccgtctacccaacggaccaagatgaggctcatagattccatccaacgtttaggagttggtcatcattttgaagaggagatcaaacaaatcctggaaggatttagtgatctaaattcttcggaagataatcttttcgatacagctttgaggtttaggttattgagacacaatggtttaccaacatctagcggcgttttcgaccaatttataaacaaagaaggggaatttaaagagtctctaaaccaagacacatgcggtatgttatccctatacgaagcaagttacttaggagctaaaggtgaagataagttgcataaggccatggaatttaccagaagccatttaaagcaaagcatgtcgagtgtgagtccagagttgcagacccaggttacaaaagccttagaacttccgaggcatcttagaatggctaccctggaagctagaaattatattgatgaatacagtcaggaaagtaatcataattctgctctcttggccttggctaaacttgagtttaatgaattgcaatcccttcacaagagggagctcgctgagatcattcgctggtggaaacaacttggtttggtggacaagttaggttttgctagagaccgaccgtttgaatgttttttatggacggtgggcatatttccagaggcgtcttattcaagtatcagggtggaacttgctaagactatttccatacttttggttgttgacgatatttatgacacttacggaagtcttgacgagctagtgttgttcaatgaagccataaggagatgggagctgggtgcaatggataagctacccgagtatatgaagatctgctatatggctttatataatacgaccaacgaaatcggttatagagttctgaaagaacatggttggtgtataaccgagcatctcaagcggacttggatagatatcttcgaggcgttcttaacagaagcagaatggtttaataaaaagcataccccaactctagaaccatacttaaccaatggtgtaacatctggtggttcttatatggcgttagttcattctttttttttgatcgggcacgatttaacagatgaaaatataagtttgatgcgtccatacccagagttatttagctgttccggaaaaattctgagactttgggacgatttgggaactgcaaaagaagagcaagaaagaggggatgtcgcaagctctatcgaatgttatatgagagaaaaaaacattgagttggaggatgaagctcgtaagcacatcaggggattaattcgctctttatggatggaactgaatggtgaactgcgagcaccttcggccttgcccaggtctataaccaaagcgtgttttgatttagctagaactgctcaagtcatatatcaacacggggacgatcagagcttctttaacgttgaagatcatgtacagtcgttattcttcagaccttgtaac

SEQ ID NO: 998 - DNA, 1605 bp, Unknown
  source: /note="Description of Unknown: GES sequence"
atggcctctgccgttccattatcttctacacctttaattaatggtgacaacagccctctgaagaatactcatcaacatgtggaagagaggtcttcaaaaagacgcgaatacttactagaagagactgctaggaaattgcagagaaatgacaccgaaagcgtagaaaaactgaaattaatagataatatccagagactcggtatcgggtattacttcgaagacgcaatagatgcagtcctaagaagtcctttctcagccgaagaagaggaagatttatttactgcagctctacgattcagattgttgagacacaatggcatacaagttactccagagattttcttgaagtttaaggatgaaaggggagaatttgacgaatcggatactttgggtctactgagcctttatgaagccagtaaccttggtgtcacaggtgaagaaattctcgaagaagccatggaatttgcagaaccaagactccgaagatcattatcagaattggcggcccctcttcgatcggaagtggcacaagctctagacgtacctagacacttgagaatggcacgactggaagccagaaggttcatagaacaatacggaaaacaaagcgatcatgacggagacttacttgaactagcaattttggattataatcaggtacaagcccaacatcaaagcgaacttactgaaattaccaggtggtggaaacaattgggtttggtggagaaacttgggttcggaagagacagagctctagaatgttttatgtggacgatgggcattttgccgcatccaaaatactctagttctagaatcgagtcggctaaggccgctgccttactctacgttatagatgatattttcgatacatatggaaaaatggatgagttgatattatttactgatgcgattagacgatgggacttggaagctatggaaggtctacccgaatatatgaaaatatgttacatggctttatacaacactactaatgaaatctgttatcgtgttttaaaggatacaggaagaatcgctttgccttaccttaaaagtgtctggatagaaaccatagaagcttatatggttgaagttaaatggtttagtggaggttccgctccgaaattagaggaatatatcgaaaatggtgcctccactgtgggagcgtatatggtgctagtccatctgttcttcttaatcggtgaaggtctcactcatcagaacgtcctatttttcaagcagaaaccttaccataaaccgttctctgcggccggccgcatttttaggttgtgggatgatttaggtacatcccaggaggaggaagaaagaggcgatatggcgtcttctattcgtctttttatgaaagagtataaattatctacggtcgaagaagcaagatcttgtgtcctggaagaaatttcgaggttgtggaaggatcttaacgagggtttaatatccataaaagacgctttaccattgacaattgttaaagtcgctctcaatattgcgagaacgagtcaagtcgtctacaaacatgaacaacatacttacatgttatcagttgataattacgttgaagcattgttctttactcctttgctgagctcc

SEQ ID NO: 999 - DNA, 1515 bp, Unknown
  source: /note="Description of Unknown: GES sequence"
atgcaacacatggaagagtcttcctctaaacgtcgcgaatacttgttggaagagaccacaaggaaattgcaaagaaatgacacagaatctgtcgaaaaattgaagttaattgacaatattcaacaattgggcatcggatactacttcgaagatgccatcaatgcggttttgaggtctcctttctcaactggagaggaggatctattcacagctgcattaagatttagattattaagacacaatggtatcgaaatttcacccgaaatttttcttaaatttaaggatgagagaggtaagtttgacgagtccgacactcttggcttgctatctttgtatgaagcttcgaaccttggtgtcgctggcgaagaaatcctggaagaagcaatggaatttgctgaagccaggttgcgtagaagtctaagcgaacctgctgccccgttacatggtgaagttgcacaagctttggatgtaccgcgacatttaagaatggctagattagaagcaagaagattcatcgagcagtatggtaagcaatccgaccatgatggagatctattagagttggctattttggattataaccaagttcaggcgcagcatcaatcagaattaaccgaaattattagatggtggaaagaattaggtctagttgataaattgtctttcggaagagatcgaccattggaatgtttcttgtggactgtcggtttgctcccagagcctaagtactctagtgttcgtattgaattggccaaagctattagtatcttgttggtgatcgacgacatattcgacacctatggtgaaatggatgatttgattctttttactgacgctatccgtagatgggatctagaggcgatggaagggcttcctgagtacatgaagatttgttatatggcattgtacaataccaccaatgaggtttgctataaagtcttaagagatacgggtagaattgtcttattgaatctcaaaagcacatggattgatatgatcgagggcttcatggaagaagctaagtggtttaatggtgggtcggctcccaaattggaggaatacattgagaatggggtaagtactgcgggtgcctacatggcctttgcacatattttctttctgattggtgagggagtcactcaccagaattctcaattatttacgcaaaagccatatccaaaggtattctcagctgcaggtagaattctgagattatgggacgacctgggtactgcaaaagaagaacaggaacgcggagacttagcctcttgcgttcagcttttcatgaaagagaaatcactgacggaagaagaggccaggtctaggatattggaagagattaaaggtctgtggcgagatctaaatggcgaactagtttacaataaaaaccttcctctgtctattataaaggttgcgcttaatatggctcgtgcctctcaagtcgtgtataagcacgaccaagatacctatttctcaagtgtggataactacgttgatgccttattttttacacaa

SEQ ID NO: 1000 - DNA, 1587 bp, Ricinus communis
atgatctcaaccatctcccagcctacgcgtaaagaaccggccacaacaaaacctgagatcatggaagagttacatgaggggacaagaaaggaattattgacttcgtcttcaccaattgccacaatgaagcttattgactccattcagcgattaggagttggttactacttcgaggaagaaatcaatacattattagatcgattcttagatttagagaccacggaagaccttctagctaccgctttgcgatttagattattgagagataactgcttcccagcacacagtgatgtttttggtaagtttatgaataaagatggtaaatttaaagaatcccttaggaaggatgtttggggtttactatctctgtatgaggcgtcatacttagggactaaggatgaagttgagctagttgaagctatggaatttactaaaacttgtcttgaagaacagtctataccacttatggcacataagctgtctaggcacgtctctcaggccttagatttgcccagacatctaaggatgcctcgtttggaagcacgcaactacattcatgaatactccttagaatcaaacaatagccctccattgttggagctagcaaaactagaatttaatgcagtccagtctttacatcagaaggaattaattgagattgttagatggtggaaacagttgggcttagtagataagttaggattcgcacgcgatagaccattagaatgctatttgtggactgtcgggattttccctgaaccatataactcaacatgtagaattgaattgaccaaaactattgccatccttttagtaattgatgacatcttcgatacttacggtagcttacctgacttgatattattcactgaggctgtccggagatgggatctaaatgcgatggaatcactcccagaatatatgaagatttgttatatggccttatataacacgactaacgacattggatttatgattttgaagcgacacggactctctatcgtcccacatctcaaaagaacttggatagatatgtttgaagcttttctcacagaagcaaagtggtttaatagcggttatgtaccaactctcgaagaatatttggataacggtgttactacgggaggcacttatatggctctggtccatagttttttcctgatgggacagggagttaacaaagaaactgtcaccatgatggaaccctatcccgatctgttctcattgtcaggccgaattctacgtttatgggacgatttaggaaccgcaagagaagagcaagaacgcggggacgttgcttgttcgatagagtgcttaatgcgcgagaaacgcatctcatgtgatgatgaaggtcggaaacaagtgcgtcagttgattaggtccctgtggacagagctgaatggggaacttattgcacccagtgcgatgcctttgtctataattaatgctagcttgaacttagctagaactgctcaggttgtctatcagcatggagacgacaaaaaaggaagtagtgtagacaatcaagttcaggccttgatatatattccaatctcctttccaaaaaggagagacttaaaattatta

SEQ ID NO: 1001 - DNA, 1611 bp, Medicago truncatula
atgttgcaaaaatctagtagtagaataatgcactcgaaattgagtatcaaatctatagctttaaatgaaaaattgtctcctttacagacagaagataaaactaaatctctcgggcaggtcaaaagacgctcaagggaggctctagttaatagcaatgatcccatcgtaaccctaaagatgatcgatagcatccaacgtctgggtataggccatcatttagaggacgaaataaacatacagctgggacgtatttgtgactgggacctttctcaagatttgtttgcaacatctcttcagtttagattgttgagacataatggctggactacctgctctgatgtgtttagaaagtttttggataagtcaggtaatttcaatgagagtctaacaaaggatgtttggggcatgctttctttatacgaagctagttacttaggtactgaggacgaagaaattctaaaaaaagccatggaattttccagggctagactgtcagagttaattccgcatctgtccccagaagtgggcaggaacatcgccaaatcactaactttacctaaacaccttagaatggccaggttggaagccagaaactacatggaagaatacagtaaaggatccaatcagataccagctttgttggaacttgcaaagttggattccgatatggttcagtcccttcatcaacgagagttagcagaaatttgtagatggtggaaagaacttggtctagttgaaaaactaggtttcgctagagatcgtccaactgaatgttttttgtggactgtaggtatattccctgaaccttgtcattccaactgccgcattgaattgacaaaaactatatgcattctgttggttatggacgacatatttgacacctatggaactctcgatgaattagtactttttaccaaggctataaaaaggtgggatctggacgcgatggatcaattacctgaatatatgaaaatttgctacatggccttatacaatacaaccaatgaaattgcctataaaatccaaaaagaacatggtttgacagtcgtaagttaccttaaaagaacttggatcgacattttcgaagcattcctagaagaagcgaagtggtttaataatggctgcgtgccaaattttaaaacatatctagataatggcgtcatttctgctggctcttgcatggcattggtccacgctaccttcctaataggcgatggcttgtctaaggagactatgtccattatgatgaagtcgtatccgaggttgttcacatgctcgggtgaaattttgagattgtgggatgaccttgggactagtacagaagaacaagaacgaggtgataacgcttctagtattcagtgcatgatgagagaaaacaacatttccgatgaaaacgaagggagaatccacattagaatgcttttaggtaatttgtggcgtgaactcaatggtttggcaacgacgaaaacaataccactgtctgtagtcaaagcatctttaaatatggcacggactgcgcaagttatttatcaacatggggatgatcaatctacctttacagtggatgattacgtccagaccctaatcttcacgtctttaccaacctctcat

SEQ ID NO: 1002 - DNA, 1632 bp, Cicer arietinum
atgagttcaacctatagaagtcggttcttatcactgcaaaagagtaagttaggcacgatgcattgtaaattttctataaaatcctcagcattgaatgataaggtagtacccttgcaatccgatgatagaagcaaatctttggagcaagtcatcagaaagagccgtgaggtgttgttaaaatctaatgacccaattgctactctcaagatgattgatagtattcaaggtttggggatttctcatcatttcgaagatgagataaatattcagctaggcagaatctgcaactgggatgccagtcaagatatttttgcaacatcgttgcagttcagattattgagacattacggttatcccacaacttccgatattttccggaaattcttggataaaagcgggaactttaaggaaagctttaccaaggacatctggggtatgttaagtctatacgaagcgagctatttgggaactgaagatgaggaggttctaaagaaggctatggaatttagcaaaacacaccttaatgaattgattcctaatctggcacctgaggtaggctcgcatatagctagggcattaacaatccctaagcatttgagaatggtcagattagaagcccggaactacatggaagagtatagacaggcgactgatcaaattccagcattccttgaattggcaaaactagatagtcaaataattcaaagcctgcatcagagggagctagaagagattttgaggtggtggaaggaattaggattagtggatagattgggttttgcacgtgatagacccaaggaatgttttttatggacggtgggaatatttcctgaaccctactatacaaattgtagaatagaaattactaagacgatatgcatcttggatattatagatgatatatttgatacatatggtacgttacacgatttagttttatttaccaaggcgataaaaagatgggatttgaatgcaatggaacagttgccagaatatatgaagatttgttacatggccttgtataatacaaccaatgaaattgcctatagaatacaaaaagaacagggtctgacggttgtttcataccttaagcgaacatggatagacatgtttgatgcatatcttgaagaagcaaagtggtttaacagcagatacgtaccgagcttcaaaacttatctcgacaacggggtaatcagttcaggatcctgcatggtcttggtacacgctacatttttgattggtgatgatctgtctaaagaaactatcagtatgatgaatagctatcctaggctattctcttgtaccggagaaattcttcgactttgggacgatttgggaacctccaaggatgagcaagaaagaggtgataatgcttgctcaatacagtgtttaatgaaggagaataacattcttgatgaaaatgtcgcacgtaagaacattagactgttaatcggaaaattatggagagaattgaatggactggcaatgacaaaaaccgtcccattatctattgttaaggcatcattgaacatggctagaacatcgcaagttatatatcagtatggagatgacaagtctacttttaccgtcgacgaatgcgttcaaactctcatatttacttcgttacccaga

SEQ ID NO: 1003 - DNA, 1593 bp, Glycine max
atggctttctctgaaaaagttccaagccagacatattatcctggtatgaaggactttgaccaggttaagagaaaatcgcaagaggctcttttaaatagtagtgattccttgagaactttagaaataatcgatactatacaaaggcttggtatcgaacatcattttgaaaaagagatcaatttgcagttgggtagaataggcgactggaacgcggcagaagatttatttgctacttccttacaatttagattattgagacactatggttggccaacatgttctgacgtattcaacaaatttttggatcagagcgggaattttaaagaaagtgttacaagggacatttggggcatgcttagtttgtatgaagcctcatacttaggtgctaagggcgaagaagtccttcaacaagctatggactacagtagagcacatctctgccaatcgttgagcgatctatcaccaaaagttgggtcgatcgtcgttgaagcactaaagctccccagacatttaagaatggggcgattggaagctaaaaatttcatggtcgaatattctcaggcttctaatcagatcccagcattacttgaactggctcgattagattacgacatgatacaaagtatgcaccaaaaggaactcgctgaaataagcagatggtggaaagaattaggacttatcgaaagactcggcttcggtcgggatggtcctagagaatgttttttgtgggtcttaggtatcttccctgagccaagatactccaactgcaggattgaacttgctaaggctatttgcatcttacaagttttggatgacatgttcgatacatatggaacattagatgaactaatcctgtttaccaaggcaatcaaaaggtgggacctagatgttatggaacaattgccggaatatatgaaaatttgctatatggcgctatataacaccacccatgagattgcgtataagatacaaaaagaccatgggcagacagtcgttgcatgccttaaaagaacatggatcgatctaatcgaggcctacttaaaggaggccaagtggtttaataataagtatgtaccaacgtttcaacaatatttggacaatggagtcatttccagcggtagctaccttgcattagttcatgcatcttttttaatcggagatgacttcagcaaggaaaccatatctatgatgaatccaccctacccgcggctgttctcttgctcgggtgaaattctgcgtctatgggatgacttaggtacttctagggatgaacaggaacgcggcgataacgcgtgctcaattcagtgtttgatgactgaaaataatatctcggatgaaaatgtggcaagacgccacatcagaaaattgattaaaaacttatggccggaacttaatgggttatcaatgactactactaccacgacactcccattatcagtcatgagagcttctttaaacatggctcgtacttcacaagttatctaccaacatggggattatcaatccatgcttactgtggatgaccacgtgcaagccctcttgttcactcctagcattaattatcaggatgaatcagatattaaccatgttatt

SEQ ID NO: 1004 - DNA, 1584 bp, Glycine max
atgtccgtggcttttagtgacaaagttccctctcaaacatacttaggtacaaaggacttagaccaagttatcagaaaaggtcaggaagccctgttgaacagcagtgatccattgcgtacgttaaaaatcatcgatacaatacagaaacttgggattgagcatcactttgaaaaagaaattaatttacagttgggtagggttggggattgggacaccgcagaagacctatttgcaacagccttgcaattccgactattgagacataatggatggcctacgtgttcagatgttttcaataagtttctggataagtccgggaactttaaggaaagcgttacaagagatatctgggggatgctctcgttgtacgaagcatcctacttaggtgcgaagggtgaggaggttttacagcaggcaatggattacagtagggcccatttgtgtcaatctttgccacatttatcacccaaagtcagatcaattgttgcagaagctctgaagttaccacggcaccagaggatggtcggtctagaagcgaagaattatatggtggaatattctcaggcatcgaatcaaatacctgccttattagaattagcaagactagattatgatatgatacaatctatgcaccaaaaggagttagccgaaatttctaggtggtggaaagaccttggattaatagagcgattgggttttggtagggatggtccaagagaatgttttttgtgggctctcggaatttttccggaacctagacactcttcttgtcgcatagaattggccaaggccatctgtgtgcttcaagttatagatgacgttttcgatacttacggcactttggacgaattagtcttgtttacgaaggctattaaaagatgggatttagatgccatggaacagttgccggagtacatgaagatatgttatatggcgttgtataacacgacacatgagattgcttataaaatacaaaaagaccattcactcactgtcgttgcttgtttaaagattacgtggattgatttaatagaagcttacttaaaagaagcaaattggtttaataacaaacatgtcccgacgttccaacaatacctcgataacggagttatatcttctggttcttacttggcactagtccatgccacgttcctcattggggatgatttgtctaaagaaaccatcttcatgatgaatccttaccccagattattttcctgcagtgggaaaattttaaggttgtgggacgatttaggaacttcaagggatgaacaagaacggggcgacaacgcatgctctatacagtgcttgatgaaacaaaacaacatcagcgatgaaaacgtagcaagaaagttaattcgacagcttattgacaatttatggccagagctaaacggattgacgatgactactaatttaccattatccgttatgcgtgcttccctaaatatggctaggacttcccaggttatttaccgtcatggtgacgatcagaacatgcctacggtcgatgaacatgttcagaccttgttattcactccctctattaattatagagatgaaaacgacatcaatcatgtcatt

SEQ ID NO: 1005 - DNA, 1557 bp, Phaseolus vulgaris
atgtcccaaactaactctacaattacgagtctggagcaactgaagatcagaagccaaaaggttctattgaactcttctgactcgttgaggaccttagaattgattgacaccattcaaagattaggtattgaacatcattttgaggaggaaattaatttgcagttaggtcgtgtgggtgattgcaataatgcgaaggacctatttgctactagtttacaatttaggttgttacgacataatggatggtccacgtcctccgatgtctttaataacttcctagataagtcgggtaactttaaagagagcgtcactcgtgatatttggggaatgttgtccttatacgaagcctcctacttcggcgctcagggcgaggaagtcttgcaacatgccatggaattttccatggcccacttgcaccaatctttgccgttattatccccatatgttggcaaagttattgtcgaggccctgaaacaccctagacatcaacgtatgtctagacttgaggcccgaaactacatggttaagtattcgaaagaatctaatcaaatcttagctctattagaattcgctcgcttagaatatgacacagtgcaatccatgcaccaaaaagaattagctgaaatatcaaggtggtggaaaaacttaggcttgattgaacgtttgggttttggcagagatggtcccagggaatgcttcctatggatgttagggattttcccagaaccttgctattcgaactgtcgtatagaattagctaaagctatatgcatcttacaagttctagacgatatgttcgacacatacggtaccttggatgaattaatcttattcacagaagcaatccaacgttgggacttagacgccatgggaaagctgccagagtatatgaagatttgttacatggcattatataacacaacccatgaaatagcctataatatccagaaagatcacggacaaaccgtagtagcttgcttaaagaaaacttggattgacctgttggaggcatatttgattgaagctaagtggttcaataaaaagtacgttccagcctttggcgaatacttagataatggagtcatctcttctggctcgtgtttagcattggtccatgcaactttcttgatcggtgataatttatctaaggaaacaatatccatgatgagtccatatcccaggcttttctcatgctctggtgaaatcttgcgtttatgggatgatttgggaacgtcaaaggaagaacagaaaagaggagataatgcctgctcaattcaatgtctaatgaaggaaaatgatatatcagatgaaacttttgctaggaagcacataagacaggtcctgggtaatttgtggagtgaattaaattcacttgtgatggctactaccacactgccttttacgattagaaaagcgtccttaaacatggcaagaacttctcaatttatctatcaacatggcgatgatcaaactatgccaaccgttaacgatctcgtaaaattactgatctttactccttcaaagtcgggcgaggaaagcaatacaaattgtgttgta

SEQ ID NO: 1006 - DNA, 1572 bp, Phaseolus vulgaris
atgcaaaagatgccatctcaaactaatccgatgactacttcacttgaacagctaaagataaaaagtcaagaagtgttattgaattcttccgacagtttgagaactttaaagcttattgataccatccaaagattaggaatagagcatcacttcgaggaagagataaatctgcaactcggtaaagtcaaggactgtaacaacgcaaaagatatattcgcaacggccctacagtttagattgttacgacaaaacgggtggtctacgtctagcgacgtatttaacaaatttcttgataaatctggaaactttaaagagtcagttaccagggacatatgggggatgctgagcttatatgaggctagctacttcggtgcccaaggagaagaggtgttacaaagagctatggaattctctatggcacacctacaccagagtctcccactgctatcacctgaggttggtcgtgtagtcgtggaggctctcaagctacccaggcaccagagaatgagccgactggaggctaagaactacatggtccaatataacaaagaatcgtcacaaattccagctttgttacagtttgcaagattagaatatgataccttgcagttaatccaccagaatgaattggttgagatatcaagatggtggaagaaccttggattaatagaaagattgggttttgggagagatggtcctagagaatgctttttgtggatgcttggtgtattcccagaaccctgctactctaattgccgcattgaattggcaaaggcaatctgtattttacaagtacttgatgacatgtttgatacatacggtaccttggatgagttgattctatttacggaggctgttcaacgttgggatctagatgccatggagaaattgccggagtatatgaagatttgttacatggcattgtataatatcactcatgaaattgcctacaaaatccaaaaggatcacggtcaaacagtcgtggcatgtttgaaaaaaacatggattgatctgttggaagcttacctaattgaagcgaagtggtttaataacaaatatgtaccaacctttggggaatatttggacaatggcgtcatttcaagcggtagttgtttagcattggtccatgctacctttctaattggggataatctttcaaaagaaaccatatctatgatgtctccatatcccaggttatttagttgcagtggcgaaattcttagactatgggatgacctcggtacgtccaaggaagaacaaaaaagaggcgataacgcgtgttctatacaatgcctaatgaaagaaaacgacatatccgatgaaacatttgcccgtaaacacattaggcaagtaattggaaatttgtggtctgagctcaattccttggtgatagcaactaccaccttaccattcacaatccgaaaagcatcattaaacatggctagaacatctcaattcatataccagcatggcgatgaccaaacgatgccaaccgtgaacgatctggtaaacgttctattgttcacgccttcttctaaaagtagagaagagtctgataccaattttgtagtt

SEQ ID NO: 1007 - DNA, 1599 bp, Phaseolus vulgaris
atgtgcaaaacttcgacaccaacaattatgcaattaagtatcaattccttgcctttaactcaaaaagttccatctcttatcgatttaggtactaagaggatggaacaagtcaagcgaagatcacaagagactttattgaactcatcagacccaatcaagacattgaaaatcatagatacaattcaaagattaggtataggacatcactttgaagaagaaattaacgtaaaattgggtaagttgagagattgggatttctctgaagacctcttctctactaccttacaatttcgtctgttacgtaataacggatggcccactagcagcgatgtgtttaaaaaatttctcgataaaagtggtaattttaaagaaagtatcacgaatgatatatggggaatgttatccatgtacgaagcatcatatttgggagctaaaggtgaggaagtactcgagaaggctatggatttttcgaccgctcatttgcaccagtcactacaacatttgtctccagacgttggtaacttggtcgcgcgagcgcttacgctcccacgtcacttacgcatgtcaagactagaggctaggaattacattaaagaatattcacaagttagttctcacatgccttacttactcgagatggctaagatcgattatgctatgcttcaaagtatgcaccaaaaggaattcgctgaaatttcaagatggtggaataaactcggtttagccgagcgtctagggttcgctcgcgataaaccagctgagtgttttctgtggactatgggtattttcccagagccatgttatagtaattgtcgtatcgaattaaccaaaacgatctgtatactattagttatggacgatatcttcgatacttatggcacgctagatgaattaatcttgtttacgaaagcgattaaaagatgggatttagatgctatggaacaattgccggaatatatgaagattagctatttggcactttataatactacccatgaaatagcctataaaatacaaatggagcatggtcaaaatgtcatttccagcttgaaaagaacatggatcgatatatttgaagcatttcttaaagaagccaagtggttcaacaataaatatgttccaactttccaagaatacttagataacggcgttatatcttcaggatcatacatggctttggtgcacgcaacattccttattggtgatgggttgagtaaagagacaattagtatgatgaacccctatccaagacttttttcttgttctggtgaaattttaagactgtgggacgatttaggtacttccaaggaagaacaagagcggggcgataatgcatgcagtatccaatgtctaatgatcgaaaataacattagtgatgagaacgtggcgaggaaacatatcagaaggtttattcgtaacctatggccagaattaaattctttggtgctgactacgacttcgttacctttttctataatgaaagcatccttgaatatggctagaactgctcaagtgatttaccaacatggtgacgacaggaacactttcactgtagatgattacgttcaaactttactctttaccccttccgcaaattat

SEQ ID NO: 1008 - DNA, 1710 bp, Morus notabilis
atggaagcttactcccctaagaagaagttaaactttgcaagacatagtgatagcttatcatgtaaatgtcaatctcaattatcgccaactactcaaccctccactctagaaatttcacataatgaaactctattaaaatcgctcgttctgcatcaagaagttgtctctaaccaagcatatcaccacgaacatgatccatcttcagtatcgtcgacgtccgacgagttgatagccaaaataaaaaaagctttgagagaaccctcctctcaaagagctaaaatgaaattagtcgatgtgattcaaagattaggtgttgggcaccattttgagaaggagattcgcttactactagaaggttttcttgactataactcaaatgagggtctctacgatgcagctttgcgttttagactacttagacataatggccttccaacatcatcagatgtattcgacaaattcatgaacaataaaggtgactttaaagaatccctgagacaggatatctggggtatgttatcactttacgaagcttcctatctcggtgctaaaggagaagacaagctactgaaggcgatggaatttacccgatcccacctaaagcagagtttaccctcattaccaccacaactacaaacccaaattgctaaatctttagaattacctagacatcttagaatggcgactcttgaagctagaaattatatagacgaatattcacaagaaagtaatcattctttggcattgcttgaacttgcagaattagaattttctgaattgcagtctcttcatagaaaggaattggctgaaattatcatctggtggaagcaattaggacttgtagagaaattgggctttgcacgtgaccgtccatttgaatgtttcctctggactgttggtgtctttccagaagcttcatattctaatataaggattgagttagccaaaaccgtttgtattttgttagtacttgatgacatttatgacacatatggtagtctggatgagttgatcttattcaatgacgctattaagagatgggaactgagcgcaatggagcaattacctgcttatatgaagatatgctatatggcattgtacaatacaacaaatgaaatagcttatagagtacttaaagaacatggatggtgtatttctgcacatttgaaacgaacctggattgatatcttcgaggcatttcttacagaagccgagtggtgtaatagaagatatactcctacgcttgaacagtatctgaccaatggtgtaacttccgggggatcttacatggccttggtgcatagcttcttcttaattggtcatgatgtcacagatgaaactgtttcaatgatggagccttatcctgaattattctcatgttctggtaaaattttaagactttgggatgaccttggaacggctaaagaggaacaagaaagaggcgatgtagcaagttcgatggagtgttacatgaaagaaaataatgttgagttagaagatgaggctcgtaagcatattaagaagatgataggtaacttgtggatggaacttaacgaacatctaatggccccatcagctttacctcgatcaatcactaaggcctgttttaacctagcaaggacagctcaaattatttaccaacacggagatgacgaaaccttttttagtgtcgaagatcacgtgcaaagcctttttttcacaccttgcaaa

SEQ ID NO: 1009 - DNA, 1569 bp, Vitis vinifera
atgtctgaggctgactcttctactcgtagaatgaaggaagttaaagagagaactcgtgaagctttttatagggcttgggatagcagggccgctatggaaatggtggatactgtggaacgattgggcttaagctatcatttcgaagatgagattaaggctcttttgcaaagattctgtgattggaactcttcggaggatttattcactacatctttgcgctttagacttttgagacagaacggttttccaacccacagcgacgttttcggtaagttcatggacaaaaatgggaagtttaaggaatcgttgaccgaagatatttggggtatgttgtcgttacacgaagcaagtcacttaggcgcgaagaatgaagaagtgttagctgaagccaaagaatttacgagaattcacctcatacaatcgatgccgcacatggagccacacttctcgtcacacgttggaagagcactagaattaccccgtcatttgagaatggcgagattagaagtcagaaattacatcggtgagtattcgagagaatccaatcctaacctggctttgcttgagttggctaagctggattttgatatggtgcaatctttgcatcaaaaagaacttgcagaaattgtccggtggtggaaacaattgggccttgttgataaattagattttgcaagagatcgacctatggaatgtttcctgtggaccgtcggtatcttcccagacccacggcatagttcgtgcagaatagaactaacgaaagcgatcgcaattctattagttattgatgatatttatgatagttacggtagtttggacgaacttgcgttatttacagacgctgtgaaacgttgggatctcggtgcaatggatcaactaccagaatatatgaagatatgttacatggcgctgtacaacacgactaacgatatagcttatagaattcttaaggagcacagatggagtgtaattgaagacttgaaaaggacttggatggacatattcggggccttcttagccgaagcgcattgctttaagggtggtcatgttcctagcctagaggaatatctaaacaacgcagttacaaccgggggcacttacatggcgctagtccatgcatttttcttgatgggtcagggtgttacaagagagaacatggctatgttgaagccttatcccaacattttttcttgttctgggaaaatcttaaggctatgggatgacctagggactgcaagggaagaacaagagagaggtgataatgcttcgagcatagagtgctacaaacgtgagcgtgagagggaaatggatactgttttggatgatgaagcttgcaggaaacacatcagacaaatgatacagtctctatgggttgagctaaatggcgagttagtcgcgagttctgctttaccattgtcaataatcaaagcagctttcaatcttagtagaaccgcccaggttatttaccagcacggtgatgacaataaaacgtcttctgttgaagaccatgtccaagctcttttgtttagaccagtatcctccaatggacatgcccagattactatgcat

SEQ ID NO: 1010 - DNA, 1659 bp, Sesamum indicum
atgtgtatgtcaagttctagctcctcttcaatgccaatgtctgttcccacagctgctccaatgatcacggctaacggtgctttactcaaatacataaggcaaccaacattgtttcctgtcgagcaagatgagggttccaaaaggagagattacctattaggaaaggttggtatgcaactgcagtctgcagcagccgctgtcgaaaagctcaaactaatagacacaattcaaaggttaggaattgcgtattatctagaagatggtataaatgcgatcctacaggctgaatttagtaatgcgttgagtacagatgatgatctttttactacagctttgagattcagattgttacgtcataacggctttcaaatttccccagacgtcttcttaaaatttatggataaaaatggtcaattcaaagagtctctgaccgacgataaattaggcttgttatctttatacgaagcttcatatctaggttccaatggtgaagaaatccttgaaaaggccatggaactaactaaaacacatttacagcgatcgctgccacagcttcctcctcaattgcagggtcaagttgctcaggctctagaactgccaaggcatttaagaatggctcggcttgaagctaggaggtatattgatcaatatgccgcacagtcagactgtgatcaggaactacttgaacttgctattctcgattacaacaaagttcaagcccaacatcaaatggagctggcggaaatcacaaggtggtggacccaattaggcttggtggacaagttaactttcgctcgcgatagacccctagaatgctttctttggagtgtaggtttattaccagaacctaagtattcgacttgcaggatagagctggcgaaaacaattgctatactgcttgtaattgatgacatatttgacacctatggaaagatggacgagttattactttttactgatgctattagacgatgggatttggaagctatggaaacacttccagaatatatgaaaatttgttatatggcactgtacaacactactaatgaaatctgttataaagtccttaaagaaaatggttggtctgttttaccatacctcaagtctacatggattgatatgattgagggatttatggtggaagcaaaatggttcaacggcggtagcgcaccaaatctggaagaatacattgaaaatggtgtgtcgaccgccggagcatatatggctttggtccacttgttcttcttgatcggtgaaggtgttactgaccacaatgccagactcctatttaaaccatacccaaaattgttttcagcggctggtagaattttgcgtctatgggacgatttaggtactgctaaagaagaggaagagagaggtgacttggcttcatctattcatttgctcatgagagagaaaaagttagccaccgaggaagaagggagatcgcgcatcctagaggatatctatggtttgtggaaagacctaaacggggaattgatagcaaaaaatggtatgccactagcgataattaaggttgctttaaacatggcgagggcctctcaagtagtttacaaacacgatgaagatacctatttctcatcagttgacaattatgtagaagcccttttctttacaccattatcatttacatacaat

SEQ ID NO: 1011 - DNA, 1587 bp, Jatropha curcas
atgtgccaatctcaaactcaatatagaaccacagccagatgtcaattatctgttattccacaatatcctgctccagaattgttgctcgcgaaccgttgcccgaaatccttagaggagctccaagaagctacaaggaaagagctgctgacgacagggaatccaactgcttctatgaaactaatcgattctattcaaagactaggtattggctaccatttcgaagaagaaatcagtatgttgctagaaagaattttagaatggaatattaacggtcacgacttattaacatcagctctgagatttagattattgaggcataatggtttaccagtgtacagtgatgttttcaggaaatttatgaacaaaaacggaaaatttaaagaatctttgagtaaggatactatgggtttattatccttacacgaagcttcatacttaggctcaaaagacgaagctgaattggtgcacgcaatggagttcacgagaaattatctccaaggttacatcgcccaaaataagaaaattggtcaagcactagagttgccccgtcacctacgtatgaccagattggaagcccgtaactatatagatgaatactctttacagaccaaccattcgcaaacattgtttcaactagccaaacttgattataatgcagttcaaagcttgcatcagaaggaattagtagaaattgtacgttggtggaaagaactggggctcgtggaaaagttgggatttgcaagagatagacccctcgaatgctatttatggacagttggtatctttcctcaaccttacgactcaaacagcagaatacaactgactaaaactgtggccattttgctagttatcgacgatatatttgacacttacggctcattttccgacttaattttgttcactgacgcagtcagaaggtgggacctgtccgctattgaatctctgccagaatacatgaaaatatgttatatggctttgtataatacaaccaatgacattgcatatatggtattaaaacagaatggttggtcgatcgtgccacaccttaagagaacctggattgacatgttcgaggcatttttgacagaagccaagtggtttaaaaacggttatgttccaactctagaagagtatttagtaaatggcgttactactggtggcacatatatggcgttggtgcatagtttttttctgctgggtcaaggtgttactaaagagaccattactatgcttgaaccttacccagatctattcacgagtgctgggaaaatactgcgcttgtgggatgatcttggcactagtagagaagagcaggaacgtggcgatgtcgcaagtagcatagaatgcttcatgaaggagaaggcaataagctgtgaaggtgaaggaagaaaggaagttagacaattaataagaaacctatgggtcgagctaaatggtgaattgatagcacctagtagaatgccactatctacaattaacgcctcctttaacctcgctaggaccgcccagattgtctatcaacatggggatgacatgaaaggcttgtctgttgatgaccaggtccaagctttgttatatcaaccaatt

SEQ ID NO: 1012 - DNA, 1674 bp, Erythranthe guttata
atgggttctaactaccgtgctagaaatttgtgtatctgtatgtctttactgtctcccttaaccattaccggtaactacgataacgcattgctcaagtacataaggcaacctatggtcttaatccctacacaagaggacgaagggactaaaaggagagaatatctactggaaaggacagcacgagaactacaggaatcgactactgtggagaaattgaagttaatagacactatccaacgtttgggcataggatattatttcgaagaagatataaacgcaatccttttagtcgagttttccaacgcacttatcacagaagataacttattcacgacagccctcagatttcgattacttagacataacggttttcaaattacctcggacgtatttcttaaattcatggatgaaaatcgtaaatttgaagaatcgctagccgatgatacactgggattgttgtctctatacgaagcttcatatatgggcgcgaatggtgaagagatcttggaggaggccacgaaatttacaaaggcctacttgcaactttcgataaggcaactctctccacctcatcatcacgatcagttagttatcgaggcattgaagttacccagacatatgagaatggcgagattagaaacccgtcaatacatagaaaaatatggggctcagtctgattgtgatgcagcattgttagaattggcaactctagactacaataaggttcagacccaacaccagattgaattagcggaaattacgagatggtggagacagcttggtttagtgaagaagcttacttttgccagggatagacctctcgagtgctttctttggacggtgggtcttctgcctgaacccaaatactccacatgtagaatcgaattagctaaaacaatagctatattgttggtcattgatgatatatttgatacatatggcaagatggacgaacttgtcatttttacagacgcgatacgacgatgggatttagaagcaatcgagaccctccctaaatacatgaaaatttgctatttagccctatataataccacaaatgaaatctgttataacgtattgaaggagaatggatggactgttttaccttaccttaaatctacttggattgatatgattgaaggttttatggtagaggcaacttggtttaacggcggtagtgaacctaatcttgaagaatacatagagaatggggtgagtactgcgggagcttatatggcctttgtgcatctgttttttttgattggagagggggttactcgtgagaattctgaattgttactgaataagccatatccaaatatcttttcgtttgccggcagaattctaagactatgggatgacctcggcacaagtaaagaagaggaagaaaggggtgacatggcatcctcgattaggctgttcatgagagaaaaaaacattgagagagaagaagaaggaagaaaaagagttttggaagaaatttatggtctgtggaaggatttaaatggtgagatgatgtgtgaaaatcgagtgatgcctttagctatcatagacgtagccttaaatatggccagagcctcgcaagtggtatacaaccacgaagaggattcatatttcagtaatgtagacaattacgttgaagcactgttctttactcctattgcctcatattta

SEQ ID NO: 1013 - DNA, 1545 bp, Vigna radiata
atgactatgacttctttcgaacagttgaagatcaagtctcaggaagttttactcgattcctctgattcactaaggaccttgaaacttattgatacgattcagcgattaggaatcgaccatcatttcgaagaagaaatcaacttgcaattaggaagattaggtgattgtaacaacgctcaagacctatttgctacagcattacaatttcgactattgaggcacaacggttgttcgacaagtagcgacgtttttaataagtttctagataagtccggtaatttcaaagaatccgccacaagagacgtatggggaatgctgtctttacacgaggcgtcatacttaggagcaaagggtgaagaagtactgcaacatgcaatggaatgctcacgggcccatctgcatcaatcattgcctcatttatctccagaagtgggaagagtagtagtcgaagcgttaaaatatcccaggcatcagaggatggctagattagaagcgaaaaactatatggttcaatacagtaaagagtcaaatcaaattccggcattattagagcttgccaggttagattacgacatggttcaaagtatgcatcaaaaagaactagcagaaatctctaggtggtggaaagatcttggattgatagagcgcttaggctttggacgagatggtcctagagaatgtttcctatggtctttgggtgtttttccagaaccccgtcatagtaactgtcgaattgagttggcaaaagccatttgcatcctgcaggttattgatgacatgttcgatacctatggtacacttgatgagctcatcctctttacagaggcagtacaaagatgggacttagacgcaatggaaaagttaccagaatatatgaagatctgttatatggctctttataacactacacatgatatagcttaccgaatccagcgcgaccatggacaaactgtcgtagcatctctaaaaaggacttggattgatctgctcgaagcatacttgaaagaagccaaatggttcaacaataagtacgtgccaactttcaaagaatacttggacaatggcgttatatcaagtggatcctgtcttgctctggtacatgctacggtgctgataggtgagaatttgtcaagagaaacaatatctttgatgtctccataccctagacttttcacatgttcaggtgaaattttgagattatgggatgatctcggtacctctaaggaagaacaagaaagaggagacaacgcctgcagtatacaatgcatcatgaaagagaatgatatactagatgaatctttcgcgagaaaacgtattagacaacttttgggtaatttatggcctgagcttaatggtttggcaatggccaatacaacgttgccatcagcagtgactaaggcttctttcaatatggctcgcacgtcacaatttatttaccagcatggagatgatcaacaaatgccaaccgtagatgatttggttcaggccctattgttcacaagttctgagaaatatagagaagaaacagatattaactttgttgtt

SEQ ID NO: 1014 - DNA, 1557 bp, Vigna radiata
atgagtgtagcatttcgtgataaagtcccaatacaaatagacccaggcaagaagaaactagaacaagtaaagagatcttcgcaagaaactctgttgaactcatctgatccaactaagactttaaagattattgatataatccaaagactaggtattggccaccattttgaagaggaaattaacgttaacctcggaaaagttagagatttcgacttttcccaagacctgtgttcaactgcattacaatttagattgttgaggcacaatggttgtcacgcctcttcggatgttttcaagaaattcctcgatcatagcggaaacttcaaagaaagtatcacaagcgatatttggggtatgttgtcaatgtatgaggcttcttatttaggggctaagggcgaggaggtactacaacaagcaatggacttctcatcagcacacctccagcagtcattgccacttctctcaccagacgtaggaaaccatgtcgtccgtgctttaacgctaccaagacacttgagaatgagccgcctggaagctaggaattatattgaggaatactcacatgtatctagtaagatgccttgcctattggaaatggcgaaaatcgataacgcaatggttcaaagcatgcatcaaaaggaattagcggacatctctagatggtggaaagatttaggtttagtcgagagcttgggttttgcaagagataagccaggagagtgctttctgtggaccgtgggtgtttttcccgaaccttgttattcaaattgtagggtggaactcgctaagactatatgtattcttcttgttatggatgatattttcgacacctatggtacactcgatgagttagtattgtttactgaagctataaaaagatgggatttggacgccatggaacaattgccagagtacatgaagattagctacctggcattatacaacacaacccaagagatagcctgcaggatacaaatggaacatggacaaaccgttctctcttgtttgaagaggacatggatggacattttcgaagcgtttttaaaagaagctaaatggttttcaaataaatacgtccctacttttcaagagtatttggctaatggtgttatatctagtggtagctatatggcccttgttcatgcaacatttctaattggagatggaatttctaaggaaaccatctcgatgatgaacccctacccaagactcttctcatgtagcggtgagattttaagactctgggatgacttaggtacatccagagaagagcaggaaagaggggataatgcttgtagcctacagtgcttgatgacagaaaacaacatttctgatgagaatgttgcaagaaaggaaattagagggttcatcagaaacctctggcctgagctaaattcattggccttgactacgactagcttgcctttttctgtcataaaggctagtctgaatatggcgcgtacgtcacaagtaatttatcaaaatggcgatgaccaaaacacgttcacagtggatgattatgtccaaactttacttttcactccagctcaaaactct

SEQ ID NO: 1015 - DNA, 1551 bp, Arachis duranensis
atgcttagggaaaaggtggaatgtctagagagcaacgaccgaaagaagtccctggagcaggtaaaaaaggaaggtcaagaggcactacttaaaaagtcttctgatcctgttggtaccatgaaaattatagattcaatccaggagttgggcataggtcaccacttcgaagaagaaataaatgctttactgggtaaaatttgccattgggatgctagtcaagatctgttcgcaacaagcttacaattcagattacttaggcataatggctggactacatttcctgaaaactttaacaaattcttagataagtcaggcaactttaaagaatccttgagtcgtgacataggaggagttctttccttatacgaagcctcttttttaggcgccgaaggcgaaggcgttctgcaacaagctatggatttcagtcgcggacatttacatcaatctattccacatatggcgccagaattgggtaggcaggtttcaagagcgctaagattaccaagacatttacaaatggaacgtctcgaagccaaaaattacatggaccaatactcgaggactacaacgaaaatacccgccctgttagaactggctaagttggattatgatatgttgcaatctctatataagagagaacttggggagattacgcgttggtggaaagagttaggactaattgagagtttgggctttgcaagggatagacctagtgaatgctttttgtggactgtgggtatttttcctgaacctaggtattctaattgtaggatcgaacttacgaagacagtctgtattctgttggttatggatgatatatttgatacatacggtagcttcgatgatttggtattatttgtgaaggcgataaagaggtgggatttggacgcaatggaacagctgccagagtacatgaaaatctgctatatggccctgtacaacacaacacatgaaatcgcctataaaattcagaaggagaggggtttgactgctgttgcttacttaaaaaaaacatggatcgatatctttgaagcctttttggaagaagctaaatggtttaaccagggttacgtaccctcttttagagaatatttggataatggtgtgatcagcgcgggttcctacatggccatgacacatgctacttttctcgttggggacggaatctctaaggacacattaagtctgatgaaaacttatccacgattattctcgtgctcaggtgagattttacgcttttgggacgatttaggaaccagtacggaagaacaagaaagaggcgacaatgcatgctctattcaatgctacatgcgggagaacaatggttgtgacgaaaatgaagccagaaagcatatcaggggattaattggtaagttatggcttgagcttaacggtgtcgccatgaacaccactgctttgccttcttcgattgtcaaagcgtgttttaacatggctaggactgctcaagttatctatcaacatggggatgacaaatcgacatacacagtggatgattatgtgcaaaccttattttttaccccgtcagccata

SEQ ID NO: 1016 - DNA, 1587 bp, Vigna angularis
atggcaatgaaacaaaataagctctctataaagagtgtggcattcagagacaaagtaccaattcagatagaccctggtaagaagaagttggaacaggttaagcgtagcagccaggaaacgctattgaacagttctgaccccacaaagacgttgaaaataattgacaatattcagagattaggtattgggcaccactttgaagaggaaattaacgtgaagttgggcaaggttgctgattgtgatttctctcaggatttatgctcaactgcactacaattcaggttattgaggcacaatggttgtcacgcgagctccgatgtatttaagaaattccttgatcactccggtaactttaaagagagtataaccaccgacatctggggaatgctatcgatgtacgaagccagctatttaggcgcaaaaggtgaagaggtgctacaacaggctatggacttctcttctgctcacctacaacaatctttacctctactcagtcctgacgttggcaatcacgttgtcagagcattgactctgcctcggcatttacgcatgtccagattagaagcaagaaattacatagaagaatactcccaagtaagctctaagatgccatatctcttagaaatggctaagatagataacgctatggttcaatctatgcaccaaaaggaattggcggatataagccgctggtggaaggacctagggttggtggaacgtttagggttcgcaagagacaaacctgcggaatgtttcctatggaccgttggcgtatttcccgagccttgctacagcaattgcagaattgaattggccaagaccatttgcattctcctagttatggacgatatttttgatacctacggtacatccgacgagttagtactatttaccgaagcaatcaagagatgggatcttgatgccatggaacagttgccagagtacatgaaaatttcttatctggccttgtacaatactatccaagaaatagcatgcagaattcaaatggagcacggtcaaacagttctttcatgtttgaagagaacctggatagatatctttgaagcttttctaaaagaagcaaaatggttttccaacaaatatgtcccaacttttgaagaatacttagctaacggcgtaatctcctctggttcatatatggccttagtacatgcgacgttcttgattggcgacggtatttcgaaggaaacaatatccttaatgaatccatacccacgtctgttttcatgttcgggtgaaattttaagattgtgggacgatttgggcacgagtcgagaagaacaagaaagaggtgataacgcatgttcactccaatgtttaatgactgaaaataacatttcagacgaaattgtcgcaaggaaacaaattcgtgggtttatcagaaatttatggccagaactaaatagtttggcattgacaactgcatctttgccttttagtgtcatcaaggccagcttgaacatggctaggaccagccaagtaatttaccaaaatggtgacgatcaaaatacttttactgttgacgattatgtacagacgttgttgttcacacctgcattagagtat

SEQ ID NO: 1017 - DNA, 1278 bp, Vigna angularis
atgacgcaaacgataccaactatgacaagtttggaacaattgaagataaagtcacaagaagtactacttgatagctctgattctttgagaaccttaaaattaattgatacaattcagagattaggtatagatcaccactttgaagaagagattaatctacaacttggaagagttgcagattgtaataatgcgcaagatttatttgcaactgcactgcaatttagattgttgaggcacaacggatggtcgacatcatccgatgtttttaataaattccttgacaagtctggtaactttaaagagagtgtgaccggtgatgtatggggtatgttatctcttcacgaggcttcttatcttggtgcagaaggtgaagaggttttgcaacatgccatggaatgttctagagcccatttgcaccagtctttacctcacctgagccctgaagttggaagagtggtggtggaagcattaaagctaccccgtcaccaacggatggttagattggaagcaaaaaactacatggtacaatatagtaaggaatcgtctcaaatccctgcattattagaactggccagactagattacgacatggtccaatctatgcatcagaaggaacttgctgaaatctctagatggtggaaagacttaggactaattgaaaggctgggcttcggtcgggatggcccaagagaatgctttctttgggcattaggggttttcccggagccgcgtcactcgaattgcagaatcgagttggcaaaagctatatgtattttgcaagtgattgatgatatgttcgatacatatggtacattggacgaattgatattgttcaccgaggccgttcaacgctgggatttagatgcaatggaaaagttgccagagtatatgaagatatgctatatggctttatataacacaacccacgaaattgcttacagaattcaaagggatcatggccagactgttgttgcgtctttgaaacgtacttggattgacttgttagaggcctacttgaaagaagcaaaatggtttaacgataagtatgtgccagcttttgaagaatacctagataatggagtgattagctcaggatcttgtttggctctggtccatgccacagttcttatcggagaaaacttgtctagggaaacaatttcacttatgagtccctatcctagattattcacctgctccggcgaaatcctgcgtttgtgggacgatttaggtacatcaaaagaagaacaagagagaggagataatgcttgctcaatccaa

SEQ ID NO: 1018 - DNA, 1515 bp, Lupinus angustifolius
atgtgctctacgaagtccttggagcaggtaaagagaaaaatacaagaaacgctactaaattccgataggttagggactctcaaaataatcgactctatccaacacttgggtattggtcatcatttcgaagaagagatcaacgcattgttgggtagagtgttagactacgatacagctcacgatttattcgcaactagcctgcattttcgcttgttgcgtcacaatgggtttcccacaagtagtgatatcttcaaaaaattctgtgataaatctggttattttaaggaaagcctatcgaaagacatttggggtatgttaagcctttatgaggcctcctacttaggtgctgaaggggaagagctgttgcacaaagccatggatttttcgaaggtccatttacataactctatttcacagctaggtccccaagtttcaatgcatattgctagaagtttgattctacccagacacctcaagatggcaaaactggaggcaaaaaattacattcacgaatactcccacgcgtcgaatcaaatacccgctcttctcgaattggctaagttagactacgatatggctcaatcactacaccaaagagaattggccgaaatatgtagatggtggaaggaactaggactggtcggtagattgggatttggtagagacaggcccgctgaatgttttctgtggactttgggtatatttccagaaccaagctattctaactgtaggattgaattgacaaagacgatttgtatattattggttatggacgatattttcgacacgtatggctctctagacgacctaattttatttactgacgcaattagaagatgggatccagacgctatggtccaattacctgagtacatgaaaatctgttatatggcgttatacaacactacacatgaaatcgcgtttaggattcaaaaagaacacggtgtaaccgtagtggcccatttgaaaaggacttggattgacatctttgaagcttttttagaagaagcaaaatggttcaacaaggggtacatgcctacattcagggaatatttaaataacggtgttatctccgcgggttcatatatggcaatggtgcatgccactttcttaattggtgatggtaactccaaggagaatatttccatgatgaaaccatacccgcgtcttttttcgtgttcaggcgaaatcctccgtctatgggatgacctgggtactagtacagaggagcaggaacgtggtgataatgcttgttccattcagtgtcacatgcgcgaaaacaacatttcggatgaaaacgaagccagaaaacatattcgggaattcattggtaaactgtggcaagaattaaatggtatcgctatgaacacaaatttgccatggagtattgttaaagcatcactcaatatggctagaacagcccaagtgatttatcaacatggtgacgataagtctacctatagtgttgacgaatatgtacagaccctgcttttcacaccatcaccacgtaattct

SEQ ID NO: 1019 - DNA, 1485 bp, Cajanus cajan
atgtcgtcgcaagaagctttactaaatacctcggattccctgaggacattgaaaacaatagacacaattcaaaggctaggcattgagcatcattttaaggaagaaattaatctacaattgggtaggttaaccaactgggaacctgttgaaaatttattcgccaccgccttgcaattccgattgttgcggcataacgggtggcctacaaggtcggacgtattcaataaattcttggataaatcaggcaattttaaggagagcgttacaaaggatatttggggaatgttaagtttatatgaaagctcttatttgggaaccaaggacgaggaagtgttgcagcaagcaatggacttctctagagcacacctacacagatctttaccttatttgtcgttagaagtgaagaatattgtaggtggtgctttaatgttacctagacatttaagaatggcacgtttagaagctaaaaactatatggttgaatgtagaaaaacctcttcacagataccagatctactaaaactggctaggctggattttgatatatcccaatcaatgcaccaaaaggaattggccgaaatctcaagatggtggaagaatctaggtttggtagaatctataggttttgggagagataagccaggtgaatgttttctctgggtattaggtatacttccagaaccctgctatagcaactgtcggattgaattggctaaagcaattagcgttctgcaagtcatggacgatatgttcgatactcatggtaagctggacgaactagttccttttacaatggcaattcgtaggtgggacctggatgcaatggaacaattgcctgagtatatgaaaatctgctatatggcattatacaataccatacatgagatcgcgtatagaatacagaaagagcatggtaagaccgttattacatgtatcaaacgaacttggatcgacatattcgaagcctatcttaaagaagctaaatggttcaataacaagtatgttccgacgttccgggagtatttggataacggcgtgatatcttcagcaagctttatggctctagtacatagtactttattgatcggtgataacttgtccgaaaaaacaatcagtatgatgatcccataccccagaattttttcgtgctctggagaaatcctacgactatgggatgatttagggacgtcgcgcgatgaacagaagagaggagataatgcttgctcaattcaatgtcttatggcagaaaataatatttcagatgaaaatgtcgcccgtaaacatattaggaaattaatagggaacctgtggttagagctaaatggtttggcattaactactaccgattttccgctatcagttgccaggactagtttaaatatggctagagcagctcaagcaatttatcaacatggcgatgaccaatcaagcttgacggtcgacgaccaagtccaggcattgttattcaccccatcagcaaattat

SEQ ID NO: 1020 - DNA, 1629 bp, Cajanus cajan
atgtcatccatgtttcaaccccggaatttgtccctgaagacaagtagaccgccaatgatttacaataaccttagcatcaagtccatagcgttcagggataaggtactattatttcaaactgacccatctacaagaaacctggaacaagtaaaacggcgttctcaggagctactgttgaacagccgtgatcccataaaaactttaaagattattgataacattcagcgattaggaattggccatcacttcgaagaagagattaacgtacagttgggcagagttggtgactgggatgtaactcaggaccttcttgctaccgcattacaatttagactattaagacataatggttggcctgcgagatcagatgctttcaaaaaatttctagacaataccggaaattttcaggaaagcattacaaatgacatccgggctatgttgtccctttacgaagcttcttacttgggagctaaaggtgaagaaatccttcaacaagcaatggatttctctacggcacaccttcatcagtcattgcctcatttatcacctgaattgggacgtatcgttgctagatcactcacccttccccgtcacttgagaatggccagacttgaagccaaaaattatatggaagaatatagccaagcctcatcgcaaataccatctttgttggaattagcaaaactagatcatgtaatggtgcaaatgatgcaccaaaaggaattagcggagatttcaggttggtggaagaaactgggcctagtcgaaagattgggctttgcaagggatagaccagaagaatgttttctatggacagtgggagtcttccctgagccatattatagcacttgtagaatcgaattgactaagactatctgcattttacttgtaatggacgacatcttcgatacctacggtaccctagacgaattaattttatttacaaaggctataaaacgttgggatctagatgcaatggagcaactaccagaatatatgaagatatgttacattgctctgtataataccacacacgagatcgcaaacaagatagaaaaagcacatggtgagtcagtcgtagcttgcttaaagaggacttggacagatattttcgaagcctttcttaaagaggctaagtggttcaacaacaaatatatccccacttttagggagtatctagataatggcgttatttcatcaggctcttatatggctatggttcatgctacattcttagtcggagatggattaagcaaagaaacaatttcaatgatgaagccttatcccagacttttcagttgtagcggtgaaatattgagactatgggacgatctgggtacttctcgagaagaacaagaaaggggcgataacgcgtgttctatccaatgttttatgacggaaaataacataagcgacgaaaacgtggcgcgtaagcatattcgcgaattaattagaaacctatggccagaattaaatggtttggcaatgactacctcggctttgccactgtccgttatgaaagctagtttgaatatggcaagaaccgctcaagttatttatcaacatggagacgagcaaaatgcttttacagtcgatgattatgtaaagactttactgtttactcaacat

SEQ ID NO: 1021 - DNA, 1509 bp, Manihot esculenta
atggcaaaccccacagcaagccttaagttgatagattctattcaacgtctgggtttagggtaccatttcgaagaagagatctcaatgcttcttgaaagatttgttgattggaatccggacgaccaggatttattggccactgctcttcgatttagattgttaagacataacggtttccctgcatcatctgatgtgttctcggagttcaagggaagggatggtaagttcaagcaatctttgtccaaagacccacttggtctgttgtcgctatacgaagctagctacttaggcacaaaggaagaagaggaactggtgcaagcaatggaatttacgagaacacacttacaaaaacgatcgttctctttgttaccttcacaacatcgtaggcaagtcgttcaggcattagaggttccgagacatctgagaatgtcacgtttggaggctagaaattacatcgacgaatactcccgggaatccaatcatagccccgatctattggatctggctaagttggattttaatgcggttcagcagttgcatcaaaaagagttagttgagatcatcaggtggtggaaacagttaggccttgtcgagaagctaggcttcgctagagatcgcccattagagtgttacttatggacagttggcattttccctgaaccatataattccaattgtcgtatcgagcttaccaaaacaatagctattctgctggttatagatgacatatttgatacttatgggtcgttgcccgatttggtgctttttactgaggctacgagaagatgggatttatcagctatggaatcactgccagaatacatgaaaatatgctatatggctttgtacaatactaccaacgatattgcgtatatggtcctcaagcaacatggatggtcgattgtacctcaccttaaaagaacctggatagacatgtttgaggcatttttagcagaagccaagtggtttaataaagaatacgtacccagtttggaagaatacttggttaacggtgtcacgacaggcggtacgtatatggctttggtgcacagcttcttcctgatgggtcaaggagttaacaagcaaaccttagctctaatggaaccataccctgacttgtttacattttcagggaaaattctaaggctgtgggacgacctaggtacagcgcgggaagaacaggaaaggggcgacgttgcctcatctattgagtgtttcatgagggaatcccggatctctggtgaagatgaagcgagaaagcagatacgtgaacttatccgctctttatggatcgaattgaacggtgagttggtagcgccgtcttctatgcccttgtgtattgtaaatgcgtcctttaacttggccagaacggcacaagttgtgtatcagcatggagatgataaaaaaggttcttctgtagatgatcaagtgcaagcattgatatataagccaatccctttagatgacgaagcaaaggtagtacatgatttagagaccatggttgtcatt

SEQ ID NO: 1022 - DNA, 1512 bp, Hevea brasiliensis
atggagcgtacccgtaaggaattattaacacctgccaatccctctgcttccttgaagtttatcgatagcatacaacggctgggtattggttatcactttgaagaagaaattaacatgttgttggaacgttgtgtggattggaatgcaggtcaagatttgttggcgacagcactgaggtttcgcttactacgccacaacggtttcccagcatgttccgatgtctttaataagtttaaagataaagacggcaaatttaatcagagtttgtcaaaggatccactcggattgctctctttgtatgaggcaagctacttgggtactgaagaggaagttgaattagtgcaagctatggaatttacaagaactcatcttcagaagatttcaatacccttattctccccgcaagatagatgccaagtttttcaggccttagagataccacgtcaccttagaatgtcaaggttggaaacaagaaactacataaacgaatatagcatggaatccaaccgaaaaccgactctattagatcttgcaaaacttgattttaatgcagtgcaattagtacaccaaaaagaattagtggagattataagatggtggaaacagctaggattggtggagaaattgggtttcgcacgcgatagacctcttgagtgctatctgtggactttaggtatatttcctgaaccctacaactctaactgtagaatcgaactaactaagacaatagcaatcttgctagttattgacgacattttcgatacttacgggttattacctgatctggtgctcttcacagaagctattagaagatgggacttatcagcaatggaaccgctacctgagtacatgaagatatgttacatggctctatacaacacaaccaacgatatagcatatatggttttgaaacaacacggatggtccatcgtaccacatcttaaacgtacctggatagatatgttcgaagcctttcttgctgaggccaaatggttcaataacgagtacgtcccatcgctagaagaatatttggttaacggcgtaactactggtggaacatatatggctttagtccatgcattttttttgatgggtcaaggtgtcacaaagcaaacagtcgcaatgatggaaccatatccagacttgttttcgttcgcagggaaaattttaagactatgggatgatttgggtacggctagggaggaacaagaacgtggcgacgtcgctagttctattcaatgcttcatgagagagaagggaatatcgtgcgaagacgaaggaaggaaacaggtgaggcaattgattcgaagcttatggattgacctaaatggggaattagtggcgccaagtagtatgcccttgagtattatcaacgctagttttaacctagcacgaactgcacaagttgtctatcagcatggcgacgacaagaagggatcatccgtcgatgaccaggttcaggcccttatatataaaccgattagtttaggtgatatgaaacaagactgtgtt

SEQ ID NO: 1023 - DNA, 1599 bp, Helianthus annuus
atggcgacaattgctatttctacaactcagggaaacgacttccttcttgttaagccgcaattggtgataagctcggagggagacgttagaaagaggatccataacttaaaggaaaacacgcgtagagcactaatgaccgcctcgaatcccgctatgaaattaaaattagtggatatgattcagagactgggattagggtacatatttgaagaagatattaaaataatgctggaaacattagcacacggacaaccggatgatgacttgtatactgtcgcattacgcttcaggatacttaggcataatggtttacacccgaacccagatgtattcggtgcattcatggatgcaaatggcaaatttggagagtctctagttgaggacacggaaggacttctcagtctttatgaggcctcttatttaggtgctaacggagaagatatcctttctcaggcgaaggagtttacaacaacgcatctaaaaaaatccgtttctaggtttacacataagctaggagagcagatccttgaatcttttgagattcctagacatttaagaatggtgagattagaagctcgacgttatattgaagaatatggcaaagacattgatcacactccagtgtttctgcaacttgctaaacttgaatataatcaagtacaatcgctacatcaaatggagctcgcagagttgagcaggtggtggagagacctaggcttagcatccaagttaacatttgctagagaccgcccaattgagtgtttcttgtggtcggttgggcttttgccggaacctaaatattctacggtacggatagaattagcaaagacagtgtcaattttattagtaattgatgatgtcttcgatacatacggcacttacgatgatctggttttgttcactaaggcaattcagagatgggatgtcgatgagatcgaacaacttcctgagtatatgaagatatgctacatggcactacataacactacaaacgaaatttgtgatgttgtacataagaatcatggcctatctgttttgccttatcttcgtaaagcttggatcgatacaatccaagcctttatggttgaggcagaatgggtgaaaagaggatatgagcccgatttaaaagattatatcgataatggaattactaccgcagggacgtatatggcccttgtccatttgttctttttaatgggagagggggtaactcctaagaacatgagttcacttttacattcttatccaccattttttactcatgctggcaagattctgagactttgggatgatttaggtacgtcaaaagaagaacaggaaaggggtgatattgccagttcggttcagttattaatgaaagagaaaaatataaaatctgaagaagatggtaggaaacagattttagaattaatccaaacatcttggaaagagctaaatgaggctttggttgctcccaacatatttccgttctccattgtcaacgttgctcttaacatgagtagagcgagccaagttgtttatcaacacgatgacgggaattcttatttttctagcgtagacgaccatgccagaagcctattttttaccccaattgatatg

SEQ ID NO: 1024 - DNA, 1578 bp, Olea europaea
atggcggaaaatggagctatgtataactacatcagacagccagtcattgtcacaccagaagtagatgatggtactaaacattctgaattagtcgaaaggaccagaagagaattacaaagatctaccaagccggttgaaactctaaaacttattgacaacttgcaacgtctcggtattgcgtattattttgaagacgatattaatgctattttagatcaattttctgacggtttgccagacgaggaccttttcactacagcgttatgctttcgtttacttagagattcaggttataaaacaggctctgacgtttttttaaaatttatggaaaaaaatatgaagtttaaagatcatttggcccaagatacaataggattattgtctctttatgaggcttcgagtatgggagcgaacggtgaagagatcttaagcgaagctaaagagttcaccgaaatacacctgaggcaatctatgccaagactagttccacaattaagaagacaagtttcgtcagctttggaattaccacgtcatctcagaatggctagattggaagccaggcgttacattgaagagtacggcaatgagagcgaccacgatcccgcagtcctcgaattggcccggctagattataataaagtacagttgcaacaccaaatggaattagctgaaatcaccaggtggtggaagcagcttggcttagttgagaagctatcttttgcgcgtgatcgaccactggaatgtttcctgtggactgttggtttacttccagaacctaaatattcttcgtgtagaatagaattagcaaaaacaatagccatcttattagtaatcgatgatatcttcgatacatatggaaaaatggaggaactggtgctcttcaccgaagcaatacaaagatgggacttagatgaattagagacgctacctccctatatgaggatttgctacatggcactttataacaccacaaatgagatatgttacaagatcctcaaggagtatggtttctgtgttctcccctatttaaaatcaacttggattgatatgatagaagggtttatggtcgaagctaactggtttaatggtgggcacggacctaacctggaagaatatatagagaacggtgtgagtaccgcaggggcttatatggccctcgttcacctgttctttttaattggagaaggtgtcactaacgaaaatattgcaaaattattgagaaaaccctacccaaaattattttctgcagcgggtagaatattaaggttatgggatgatttaggtacagctaaggaagaagaagaaagaggtgacttagctagttgcatgcagattttgatgagggagaaaaacatagattgtgaaaacgaaggtaggaattatatcttaaaagctattaacggtttatggaaagacctaaacgacgagttgataagtcctaatgcaatgcctctagccataactaaggtagctttgaatatggcccgagcatcagaagttgtttacaagcatgaagaggattcttacttctccagtgtagataactatgtgcaagcactatttttcactccaattaac

SEQ ID NO: 1025 - DNA, 1524 bp, Lactuca sativa
atgtctgaagtacatggtagcaatagagtaactgaattaaaggaaaaaattagagcattaatgacagacagcaatccaatcatacttatggagttggtagataaaattcaacgtttaggtctcggttgcacgtttgaagaggatatcaataaaatcatgaaatacttggtacaaggtcatccaaatgacgatctttacaccgttagtcttaggtttagacttttgagacacaatggtttgcacgtcaatcctgacgtatttggcagttttatggatgcaaacggtaaatttaaagaatctttatcagaggacattgaagcactattgtcgttatatgaagcttcctatatgggagcagacggtgaagatatattatctgaagcaagagaattcacgacaagacaccttaagaaatcagtttttaagttgaccccactgttgagaaacaaagtcctgcaatcactgaagctacctagacatttgagaatggagaggttagaagcaagaatgtacatcgaagaatatggtaatgaacaagaccatatcccaattttactagaactggctaagcttgaatataatgaaattcaaatactacaccagatggaaatctctgaaataaccaggtggtggaaacacttaggactgactgacaagttaccatttgccagagataggccactagaatgttttctttggacggttggtttgttaccagaacggaaatactctaccaaacgtatcgaagtggcaaagaccatttcgattctgttggtaatcgatgatatttttgatacctacggttcatacgatgacctagttctatttacaaaggcgatacagagatgggatatgcaagaaatcgaacaattgcctgaatacatgaaaatatgttacatggcattgtgtaatacaacgaacgaaatctgctatgaaatcttgaaggaacatgggttaaatgtgttgccttttctgagaaagacgtggatagaaatggttgaagcgtttatggtggaagctgagtgggtcaaaagaggtaccgaacctaatttgaaagactacattgagaatggtgtgaagacggctggtacttacatggccttagtgcacttattcttccttataggtgagggcgtgacacctgaaaacatgcgtaccctaactgattcgtatccaagttttttctcaatttctggcaccattcttcgtttatgggatgatctaggcacctcgaaggaggaacaagagcgtggcgatgtagcttcttctattcaattattgatgaaagaaaaaaatatcacttgcgaggaagaaggacgtaagtatatcttgcaatttattgatagttcctggaaggaactgaataagactcttgtggttccaaatacgttgcccatctctataataagaatagccttaaatatggctagagcttcccaagtagtttatcaacatgaagaatcttcttactttagtagggttgataatcacgttaaatcgttattttttgctccaattcaaatt

SEQ ID NO: 1026 - DNA, 1551 bp, Citrus clementina
atgcaaaacgttctaacctatgaaggggatagaggcactaaatcacttgaggaagagttgcaagagagaaccagaaaagctttaagaaaatcctcaaacgatccaaccgcaactatgaagttgattgataccattcagcgtttgggtattggatatcactttgaggatgaaataatggaacgccttgagaggttctcggatggagacgcagccggtgaagagaacttgtttgagaacgccctcagattcagactgctaaggcataacggtctgcctgcatgcacagacatttttaaaaaattcataaataaggagggtaaattaaaggaaagtgtatcaaaggatacaagaggtatgttgtctttatatgaagcatcctacttggctactcaagataaagatattctgtttgaagctatggaattcacaaaaacagaacttacccaaagtgtgtccctaatggattcacagtctagccgtcatgtcgttcaagccttagccctaccaagacatttaagaatgtctagaagcgaagcgggtaattacattaatgaatacagtcaaagttggaatcatgatcaaacactacttcaacttgctaaaagtgatttcaacatggtccaaagcttgcaccaacgggaattggccgaaattaagagatggtggaagcaattaggcctagtagacaaactaggttttggtcgtgacagaccacttgaatgttttttgtggactgtgggaatatttcccgaaccgtattattctaattgcaggatagagttggcaaagacaatcgctcttttacttgttattgacgatatattcgacacatacggaagtttatccgacttggtcctatttactgaggctatacaaaggtgggaccttggggcaatggaacacatacccgaatacatgaaaatttgttacatggccttatacaacacaacaaatgagatttcatacagaatccttaaagatcatggttggaatgttgtcccacaattaaagagaacttggatcgatattttcgaggctcaattgtcagaagcgaaatggttttcggaggggtacgtccctacccaagaacagtatttgaggaatggtgttactacaggcggcacctatatggcgttagttcatgcgttttgtttgatgggtcaagacgtgaccaaagaaacattggcaatgatggagccctatccaaatctgttttcatgttctggcaaaatcctgagattatgggacgatctgggtactgcaagagaagaacaagagcgtggcgatgtggcgtcgagtatagaatgttatatgcgagaaaaaacaataagttgcgaagaagaggctagaaaacatattaggcaactcataagatccctgtgggttgaattaaatggtatgcttgttgccccagcagctcttccagcttctattgttaatgcatcccttaatttagctaggacggcacaagtggtttatcaacatggcgacgataatactgttacgagtgttaatggtcatatcgaaagattattttgcaaccccctaaca

SEQ ID NO: 1027 - DNA, 1695 bp, Medicago truncatula
atggttgtgactgagttaagagtttcgtgcttaacctcagcacttagttgctgtaattccaggtcgtctacataccattcacgcattttattgttgcaaaaatcaaaacccgggtttatgcacagaaagttgtctattaattctacagctttgaacgacaaagttgcgccactgcaaacggatgattccaccaagagccttgaacaggttaaaagaaaaagccaggaagctttacttaactcctctgaccccatggtggctctaaagatgatagacagcattcaaggattagggatagggcaccatttggaagatgaaattaatattcagttaggaagaatatgtgattgggatttaagtctagacctattcggaacttcactgcaatttagattactccgacataacggctggcctacgtgttccgacgtttttaagaaatatttggataagtctgggaattttaaggaatcgctcacaaaagatatatggggaatgctttccctatacgaagctagccacttaggtacagaagatgaagaaatattaaagagagctatgaaattctctagcgctcacctcaacgaattaatcccacacttgtctcctgaaataggtagaaacatagcaaagtcacttactttacctaaacatttacgaatggctagattggaggctaggaactacatggaggaatacagcaagggatccaatcaaattccagctctcttggaactagccaagttggatagcgatatggttcagtcattgcaccaaagagaattaacagaaatttgtcgttggtcaaaagaattgggattgatagaacggttaagtttcgcaagagatagacctacggagtgtttcttatggactgttggaatctttcctgagccgtgctattcaaattgtcgtatagaattgacgaaaactatatgcattttagacgttatagatgacatttttgataattatgggacattagaagacctggtgttgttcactaaagcaattaagaggtgggacttggatggtatggaacaacttccggaatacatgaaaatttgttatatggcattatacaacacgactaacgaaatcgcctatcgcattcagaaggagcatggtttgacagttgttagttgtctgaaaaagacttggatggatatgtttgatgcttatttggaggaagcaaaatggtttaattcaggttatgtgcctagcttcaaaacttatcttgataacggtgttatttcagtcggctcgtgcatggcattagttcacagcacctttctgattggtgatggcctgtctaaagagaccatttccatgatgaagcaataccctcgattgttcagctgttctggagaaattctccgcctgtgggatgatttgggtacctccaccgaggaacaggaaagaggggacaatgcctgctccatacaatgcctcatgaaagaaaataatatttcggatgaaaacgaagcacgtaaacatttgcgtttattaattggtaatttgtggagggagctgaacggtctggccatgagcaagacaattcctttgagcgtagttaaagcctccttgaatatggccagaacggcacaagttatttaccaacatggagacgatcaatctaccttcacggttgatgattacgtgcagacattgatttttacatcgttccccaatagt

SEQ ID NO: 1028 - DNA, 1740 bp, Cicer arietinum
atggccgtcatcaatgaactgagaatttcttatcttacaaacagtatcgctcggtcgtactccagaataagcatttaccaatcacaaattttgtctcttcagaagtctaaatcggaaattatgcacagcaagtttacgattaaatctgtagctttgaatcataaagtcgtgcctttacaatctgatgataggtcaaaaagcctagaacaagttattcgacgatcaagagaagtattattgaattcaagtgatccaattttaaccttgaaaatgatcgactcaattcaaggattgggtataagtcatcacttcgaagatgaaatcaatatccagcttggtagaatttgcaactgggatacttcccaagacatttttgctacttccttgcaatttcgattgttacgacataatggatacccaaccacatctgacgtttttagaaaatttcttgataagagtggtaactttaaagaatcgttcaccaaggatatatggggtatgttgtctctttacgaagcttctcatttgggtacagaggacgaagaagtattaaaaaaagcaatggaattttcgaaaactcacctgaatgaactgattcctaatttggcaccagaagttggtagtcacattgcaagagctttgacaataccgaaacaccttagaatggtaagattagaagcacgcaactatatggaagaatatcgtcaggctactgaccaaatttccgtcttcctagaattggcaaaattagatagtcaaattattcagagtttacaccaacgcgaacttgccgaaatctccagatggtggaaggaattgggtgttgttgatagaattggtttcggtcgtgatagaccaactgaatgttttctatggaccgtcggtatatttccagaaccttactacacaaattgtagaatcgaattgaccaaaaccatatgtatattgttagttatggatgatatctttgacacttatggcacttttcacgaactagtattatttacaaacgcaataaaacgctgggacttagacgcaatggagcaacttccagaatatatgaaaatctgttacatggccttgtataatactactaatgaaattgcttacagaattcaaaaagaacatggtttaaatgttgtaagtcatctgaaaagaacctggattgatattttcgatgccttcctagaggaggcaaagtggtttaattccggttatgtaccctcattcaaaacttacctggataatggcgtaataagtgcgggttcatgtatggccttagttcatgcgacttttttaattggcaaccatgttcatgggttatcaaaagaaacctttagtacgacgaagccatacccacgcttattttcatgttccggggaaatcttaagactttgggatgatctaggtactagcacagaagaacaagaaagaggggataatgcatccagcatacaatgtttgatgagagaaaataacattagtgatgaaaacgaagggcgtaagcacataaggttgctaattgggaagctatggcgggaattaaatggattagtcatgacaaagactatccctttctctattgtgaaggcttctttgaacatggctagaacctcacaattaatttatcaacacggcgatgataagactacttttacagttgacgactatgttcagactctaatatttacttcgcgtggtggtcatggttccgacagagtgggttttggtagcaagact

SEQ ID NO: 1029 - DNA, 1941 bp, Citrus sinensis
atggcgagcgcactggttgatgatgatgaagacggaaatcaacaccaccaagatccaaaacgtcaatatgaacaatgtctaaagaaatgtgaaaggcgtgaaggaggtgttgtcgctgttcaagctgcagccagaaaccggtcgcgtaagagtaatgaagaagaaaagaaaagagaatgcttgacaccacaagcaaccggaagggaccaaaaaaagtccaacaaaggagcaatcttgacaacatttacgaataaagatagcgggccattggtctccttacgcactaggtcatggcagcaaggaaggtcattacacagtaactcattgtcatgtatttgccaattatctagtttacctaagccactcgttacagactttaagaccagtccaaggcaaaatgtcttgacctatgaaggtgacaggggcacaaagagtctggaggaggaattacaagaaaggacccgaaaggccctacgcaaatcctctaacgacccaaccgctacaatgaaattgatagacactatccaacgattgggtattggctaccactttgaagatgaaataatggaacgtttagaaaggtttagtgatggtgacgctgcaggtgaggaaaatttgtttgagaacgccttaagatttaggctccttaggcacaatggactgccagcatgtaccgacattttcaaaaagttcataaacaaggaaggtaaattgaaagagagcgtttctaaagatacgaggggaatgttatcattgtacgaagcatcttatctagcaacccaagacaaagatattctttttgaagctatggaatttaccaaaactgaattgactcaatctgttagccttatggattcccaatcgtctcgccatgtggtgcaagccttagctttgccacggcacctacggatgtccagaagtgaagcaggtaactacattaatgagtattcgcaatcttggaatcatgaccaaactttattgcaactagcgaaatcagacttcaacatggtccaatcgttacaccaaagggaactagcggaaatcaaaaggtggtggaaacaactaggtttggttgataaattaggtttcgggcgtgaccgtccattggagtgttttttatggaccgtgggtatttttccagagccgtattattctaattgcagaattgaattagccaaaacgatcgccctccttttagttattgatgatatctttgacacctatggttctttatctgacttggttttatttacggaggcgattcagagatgggacttaggtgccatggaacacataccggaatatatgaaaatttgttatatggccttgtataacacaactaatgaaatttcataccgtatacttaaagaccatggctggaatgttgtaccccaattaaaaaggacttggattgatatttttgaagctcaattgagtgaggcaaaatggttctctgaaggatatgtccccacacaggagcaatatttgagaaatggtgtcactaccggaggtacgtacatggctttggtccacgctttctgcctaatgggtcaagacgtcactaaggaaacactggccatgatggagccctatccgaacctcttttcgtgctctggaaaaatcctacgattatgggatgacttgggaacagctagagaagaacaagaaaggggcgacgtagcaagttcgatcgaatgttatatgcgcgaaaaaacaatatcatgcgaagaagaggctagaaaacatattaggcaattgattcggtctttatgggtggagcttaatggtatgctagtcgcaccggcggccctgccagcttccattgttaatgcctcattgaacttggcgcgcacagctcaagtagtttatcaacacggtgacgataataccgttacttccgtgaatgggcatatcgaaagactgttctgtaatcccttgacc

SEQ ID NO: 1030 - DNA, 1542 bp, Vigna angularis
atgagttttgttcccatacaaatagatccaggcaaaaagaaactagaacaagttaagagatcttcccaagaaacgctgttgaactcgtcagatcctactaaaactctaaaaataatcgataacattcagagattgggcattgggcaccattttgaggaggagattaacgtaaagctaggtaaagttgccgattgcgactttagccaggacctttgtagcaccgctttgcaatttagactactcagacacaacggttgtcatgctagttccgatgtgtttaagaaatttctcgaccattcaggcaacttcaaggaaagcattaccacggatatttggggtatgttgagtatgtacgaggcatcttatctaggagctaaaggtgaagaggttttgcaacaagccatggatttttccagtgcccacttacaacaatctttgcctttattgagtcctgatgttggaaatcatgtggtcagagcgctcactcttccaagacacttacgtatgtctagattggaagccagaaattacatcgaagaatattcacaagtatcctctaaaatgccatacttattagaaatggctaagatagataacgctatggttcaatcaatgcatcagaaagagttggccgatatatccaggtggtggaaagatctaggtctcgtggaaagattagggtttgccagagataagccagctgaatgttttttgtggacggtaggtgttttcccagaaccatgttattctaactgtaggatagagttggcgaagacgatttgtatcttattggtcatggacgacatattcgacacctatggaactagtgacgagctggttttattcacagaagccatcaagagatgggatctagacgctatggaacaattgccagaatatatgaaaatctcataccttgctctatataatactatccaggagatcgcctgtcgcattcaaatggagcatggacaaactgtcctgtcttgcttaaaacgtacatggattgatattttcgaggccttcttaaaagaggcaaaatggttttctaacaagtacgttccaacatttgaagaatatttagcaaacggtgttatatcttcaggttcttatatggcgttggttcacgccacttttttgattggggatggtattagtaaggaaacgatctctttaatgaatccttacccgagattattttcctgtagcggtgaaattttaagattgtgggacgacttaggtacctctagggaagaacaggagagaggagataacgcgtgctcgttgcaatgccttatgacagagaacaatatttctgatgaaatagtcgctaggaagcaaatccgaggttttattaggaatttgtggcccgaattaaactcactggctttaacaactgcaagtttaccattttcagtcataaaggccagtttgaatatggccagaacttcccaggtaatatatcaaaacggagatgaccaaaatacatttactgtcgatgactacgttcaaacactgctttttactccagccctagaatac

SEQ ID NO: 1031 - DNA, 1857 bp, Helianthus annuus
atgccctacttgatgttccataccacatattatataaatcacatacaacttaagagaaacaaaggaatggcttctcaagcctacatcacatcaattttttctcacaaggtattatatcaaagacagttaataatcattcctcccttcaagggttccaaaaactgtagatctatatttagttcagcgcaggcatgcccaaatacaatcacatctgctacagaagagttaattgataccttgagtccactttctatgactgacacagtttcttattcaggtgatcgaaatagtctaatattggatcactatggtatgatggttatcccaccgcacgatgtcaataatcgtatcgaagaactcaaagagtatacccggagagccttaatgaatacaagtgattctactatgaccttgaaattaattgataccatacagaggctgggtgttggctattattatgaagaagaggagatcaggaaaattttgaaaaaactcactcatgttttgcccaaagacgatctttacactgtcgcccttcattttagattacaacgtcattatgggctgcatactaatccagctgccgaagttttcagaaactttatggatgaaaatggtgaattaaagaaaagttcaagcgaggatatagaaggtgtgttatcattatatgaagcttcatgccttggttcctccggtgaagacttcctactgcatcacaaagagatcactagaagatatcttagtagatcagtgtctaaactgtccctaaaactgcataagaatgtagttgaaggcctaaaattgcctcggcatatgaggatggaaagattggaagctaggagatatattgaagaatatggtaacgaagatgatcacaatccatttgtattggaatttgcaaagtatgactacaataaagttcaatcagtattccaaagagagcttgtagaagtaaatagatggtgggaacatttgggtctaagtagtaagttgggctttgttagagatagacacgttgaatgtttcttgtggaccgtggggcttcttcccgaaccatcttttagtggctcaagaattgaacttgcgaagacaattgctattatgttagttatcgatgatatttatgatacttatggtagttacgatgatctggttttattcacagaggctataaaaaggtgggatttaaatgctatcgaacaattgccagaatacatgaaaatctgttatcaagctttgtacaatacaaataacgaaatttgcgataaaataaaaaaggagagatgtctttcagtacaaccctttcttagaaaaacttggatcgacatggctgaggcctacatggtcgaagcggaatgggtcaaaagaggtcgtatacctacattgaacgactacattgaaaatggagtaaccacctcaggaacctatatggctttagtacatctgttttttttgatttcttacggtttaacaacggaaaacatgaaacatctgctcgacccatatcccaaattcttcactatggctggtactattttgcgcctatgggatgacttgggcacgattaaagaagaacaagagcgaggggatatgctttcgtcaatccatttgttaatgaaagaagagaatataacttgtgaggaagaaggtagggaaggtattcttcaaatgatctacgccttatggaatgacttgaacgttgaactattaacgcctgatgccgttttattcaggatgattaaggtagccttgaatatgagcagaacaagtcaggtagtatatcaacataacgatgactcataccttctaagcgttaaggatcatgtacagtccctcttctacgaaccagtagatatt

SEQ ID NO: 1032 - DNA, 1854 bp, Helianthus annuus
atgccttatttaatgtttcacactacatattatataaatcacatccagcttaaaagaaataagggtatggcatctcaagcatatataacgtctatcttttcccacaaagtgttgtatcaaaggcaattgattatcatacctccttttaaaggctctaagaactgcaggtctattttttcttcagcccaggcctgccccaacacaataacctctgcaactgaagaacttatcgatacactaagtcccttatcaatgacggatactgtttcgtatagtggtgatagaaactcattaatcttggaccactatggaatgatggttataccacctcatgatgtcaacaacagaatcgaagagctaaaggaatacactagaagggcgttaatgaataccagtgattcgacaatgacgctgaaattgattgacacaatccaaagattaggggtgggttactactatgaagaggaggaaataaggaaaattttgaaaaagctgacgcatgtgctacctaaagacgacttgtataccgtggccttgcacttccgtctccaaagacactacggacttcacactaatcctgcagaggtttttaggaattttatggacgaaaacggggaattgaagaaatcgagtagcgaggatattgaaggtgttttaagcctgtatgaagcttcttgcttgggctcatcaggggaagattttttgttacaccacaaagaaatcacgcgtcgatatttatcaagatccgtctcaaaactgtcattgaagttgcacaaaaatgtcgttgaaggcttgaaactaccccgtcacatgagaatggaaagattggaggctaggcgctacatcgaagagtatgggaacgaagacgatcataatccatttgtgttagaattcgccaaatacgattacaataaggtccagtcagtgttccagagagaattagtcgaagttaataggtggtgggaacatctaggcttaagtagtaagttgggttttgtcagggatcgtcatgtggaatgtttcttgtggacggtaggtttgctacccgaaccgtcgttctccggttctagaattgagttggcaaaaactattgcgattatgttggtgatagatgatatttacgatacgtacgggagttatgatgacttagtattatttacagaagcaataaaaagatgggatctcaacgctatagaacaactaccagagtatatgaaaatttgttatcaggccttgtacaatactaacaacgagatttgcgacaaaattaaaaaggagcgctgcctgtctgttcagccattcctgcgtaaaacttggatcgacatggctgaagcttatatggttgaagcagagtgggttaaacgaggtcgtattccgactttgaatgactatatagagaatggtgtaacaacgtcgggtacgtatatggctcttgtacatttgtttttcctcatctcttacggattgacaacagaaaacatgaaacacttgctggatccttaccctaagttttttacgatggctggcactattctgagattatgggatgatttgggaacaattaaggaagaacaagaaaggggtgacatgttgtcatctattcatttattaatgaaagaggaaaatatcacgtgtgaagaagaaggaagggaaggtatcctacaaatgatatatgctctatggaacgatcttaacgtggagttattaactccggatgccgtcttattcaggatgatcaaggttgcactgaacatgtctagaacctcacaagttgtgtatcaacataatgatgattcctacttattatctgtaaaggatcacgtacaatcccttttctatgaaccagtagacatt

SEQ ID NO: 1033 - DNA, 1647 bp, Helianthus annuus
atgccgtacttaatgtttcatactacttattatattaatcatattcaactcaaaagaaataaaggaatggccagccaagcatatatcactagcatatttagtcataaagttttatatcaaagacaacttataatcatccctcccttcaaggggtctaaaaattgcagatcaattttctcttcagcacaagcatgccctaacactattacgtccgcgactgaggagctaatcgacactttgtcccctctcagtatgaccgatacggtatcctattccggtgatcgtaactctctaatacttgaccattacgggatgatggtgatacctcctcatgatgtcaataataggatcgaagagttgaaggagtacactaggagagcgttaatgaacacgtccgattcaaccatgacgttaaaattaattgacaccatacagaggcttggtgtcggttactattatgaagaagaagagatcagaaaaattttgaagaaactgactcacgtgttgcctaaggacgacttgtacacagttgctttacacttcagattgcagaggcattatggacttcacaccaatcctgctggcttaaagttgcctcgtcacatgaggatggaaagattggaagcaagaagatatattgaagaatacggtaacgaggacgatcataacccatttgtcctggagtttgcgaaatacgactacaataaagtccaaagtgtctttcaaagggaattggtcgaagtcaatagatggtgggaacatttgggactttccagtaaattgggatttgttagggacagacatgtggaatgctttttgtggactgtgggtcttttgccagaaccatccttttcgggatcccgaattgaactagccaagactatagcaattatgttagtgattgatgatatatatgatacatatggttcttacgatgacttggtattgtttacggaagctattaaaaggtgggatcttaacgcaatcgaacaattacccgagtacatgaaaatctgctaccaggcactctataataccaacaatgaaatttgtgataagattaagaaagagagatgtttgagtgtacaacctttcttgagaaaaacttggatagacatggccgaagcttacatggttgaagccgaatgggttaagagaggaagaataccgactcttaacgactacatcgaaaatggagttacaaccagcggcacgtatatggcattagtgcatttgttcttccttatctcctatggtttaaccaccgagaatatgaagcatttgctagatccatatccaaagtttttcacaatggccggaacaatcttaagattgtgggacgacttaggtactatcaaggaggaacaagaacgaggcgatatgttgagttctatacaccttcttatgaaagaagaaaacattacgtgtgaagaggaaggtcgagaaggtattttacagatgatctacgcattatggaatgacttgaatgtagaactcttgactcctgacgcggtcctgtttagaatgattaaagttgcattaaatatgagcagaaccagtcaagtcgtttatcaacataatgatgattcttatctattgtcagtgaaggatcatgtccaatcacttttttatgagccagtggacatt

SEQ ID NO: 1034 - DNA, 1524 bp, Olea europaea
atggaaaacattaattgttcagagagaatcgaagagttacgtgagaatactaggaaggctctcagaagagcgctcgatccaatggccgcgatggagttgattgataccttacaatggctgggtatagcatataactacgaagaagaaattgattcctggttgaataagctaataaattgggacgcaggtgatgacttacacgctacaggtttaaggttcaggttactgagaacagaaggtttgcctgtctcctgcgacgtttttgaaaagttcatggaaaagaacggtaagtttaaagagtcgatttcgcaagatacgagaggcctcctttcgttatacgaagcctcaagtctcggtgcctccggagaggacatccttagtgaagctatgagattcgccgttacccatctgcgtttatcgataccgtcgatgggtaaacaactgtgccggcaagttactcgggcgctagagctaccacgccacctgcgtatggcgagactggagtcacgactttatattgatgagtattccatgggttctaatttctcacaaatattgttggagcaagcgaaattagactataataaggtacaatcgttacatcaaatcgagcttgccgaactgagtagatggtggaaacagctaggtttagttgaaaaattaaaatttggtagagacaggcctatggaatgttacttctggacagtcggcatattgcccgatccaaaatactcacaagcgagaatcgaactagcaaaaactatagcaatactactggtgattgatgatatttttgatacatacggttccattaacgaactattgttgtttaatgacgcaatccagaaatggaacttggacgccattgagcaattgcctgcttacatgaaaatctgttatatggcattatacaataataccaatgagattgcttattctatattaaaggaacagggccgcaacgtgcttccgtctttgaaacaagtttggatgaacactatagaggcatttatgattgaagcaaactggtttaattccgggcatgttccaaacttagccaattatttgaagaatgcggtaactacaagtggcagttacatggctttagtacatattttttttttacttggagaaggtatttcacacggtaacgttaaatcaatggagaaaccatatcctaaaatcttctcttgctctggtcaaattttaagattgtgggatgatttgggtactagtaaagaagagcaagaccggggggacaacgccagcagcatcccactattcatgaaggagaaaaacttaccatccgaagatgaagcaagagagtgtataatgcaattaattggaaatttatggaaagagttgaataccgaactgttatctagttctttaccgttaccaattattcgtgcttgcttcaacatgtctcgtacgtccgaagtgatttatcaacatgaagaagactcgtatagcagtggtgttgacaattttgtcaagtttttgctcttggaacccattggcttg

SEQ ID NO: 1035 - DNA, 1815 bp, Olea europaea
atgctaccacaatctcatattgcattggacaggcataagttaagagaatccgaaaaaatagatgagtcggcccacaaaccattagagcaacaaggacgcgagaatgtcattggaaatgacagaatggctattgaaagaatagatatagctgttgtgtctgctatcagatctactaacaaggattttaacatcgagcgaactgcgaagttaggcgtcaaagtattcactggcacagtagatccggcggttgctcaggcatggatgactaaaatagaaagagtattacatacgatggaaaacattaactcatcagagagaatcgaagaattgagagaaaatactcgaaaagtgctgcgaagggccttagatccgatggcagctatggagttgatcgataccttacagtggatcggcattgcatacaattacgaagaagaaatcgactcttggctaaataagttaattagttgggacgcaggagatgatttacacgccacggcattaagatttagattgttgagatcggaagggttaccagtgagttgtgatgtgttcaagaagtttatggaaaaaaacggaaaatttaaagaatccattagtcaagacactcgtggactgttgtcgttatatgaagcgtcctctctaggggcgtccggtgaagacatattgtcagaagcgatgagatttgcagttacgcagcttaggctttcaatgccttcaatgggaaaacagctgtgtaggcaggtaactagagccttagagctgcctagacatcttcgtatggctaggttggaaagcaggttatatattgacgaatactccatggggtcaaacttcaatcaaattctattagaacaagctaagttagattacaacaaagtacaatcgctacaccagattgaactcgctgaattatctaggtggtggaagcagttaggactcgttgagaaacttaagttcggcagagatagacctatggaatgctatttttggaccgttggcattttaccagatccaaagtattcacagccgcggattgagcttgcaaaaactattgcaatcctgttagttattgatgatatctttgacacatacggttcgatcaacgaattactcctgtttaacgatgctattcagaagtggaatctggacgcgatagaacaattgccagcctacatgaaaatctgctacatggctttgtacaatacttcaaatgagatagcctataacattttaaaggaacagggacgaaatgtgttgccttcattgaaaagggtttggatgaatactattgaagcctttatgatagaagccaattggtttagttccgggcatgttccagatttggcaaactacttaaaaaacgctgtcaccacaagtggcagctacatggctcttgtgcatattttttttttattaggggaaggtatatctcatggtaacgttaagtctatggaaaaaccatatccgaagatcttcagttgttctggtcaaattttgagactatgggacgacctgggaacatctaaagaagagcaagataggggagacaacgccagtagcattcccctatttatgaaggaaaaaaatctgccgagtgagggagaagcaagagaatgcatcatgcaactgattggtaacttatggaaagagttgaatactgaacttttaagctcttccctgcctttaccaataataagagcctgtttcaatatgagcaggacttctcaagtaatttaccagcatgaagaagattcttattcctctggtgtagataatttcgtgaaattcttgctcttggagcctattgggctg

SEQ ID NO: 1036 - DNA, 1524 bp, Olea europaea
atggataaaactatatgttccaagggaattgaagaactccaagaaagaactagaaacgctcttcaaagagctcttgaccctatggctgcgatggaattgattgatactcttcagtggttggggattgcttacaattatgaagaagaaatagactcctggttaaataagctaattaattgggatgctggcgacgatttacacgctactgcacttcgttttagactattaaggactgatggctttcctgtgtcttccgatgtgtttaaaaagtttatggaaaagaatggtaagtttaaagagtccatttctcaagacacaagaggcctattatctctgtatgaggcttcgtctttaggggcaagcggtgaagacatactgtccgaagccatgagattcgcggtaacgcatttgagattatctatgccttctatgggtaaaagattgtgtagacaggttaccagagctttagaacttccgaggcatttgagaatggctagactagaaagtcgtctatatattgacgagtattccatgggatcgaacttcaaccaaattttattggaacaggctaaattagactacaataaggttcaatccttacatcaaattgaattagctgagttgtccagatggtggaaacaattaggtttagtcgagaagctcaaattcggcagggatagacctatggagtgttatttctggacaattggcatcttgccagatccaaagtattcgcaaccaaggatcgagctcgctaagacaatagcgattttattagtgatagatgacatattcgatacgtatggttccattaatgagttacttctttttaatgatgccattcaaaagtggaaccttgatgctatagaacagcttccagcatatatgaaaatttgctatatggcattgtacaacactaccaacgaaatagcctacaatattctgaaggagcaagggagaaatgtgttgccatcgctgaaaagggtttggatgaatacaatcgaggccttcatgattgaagcgaactggttcaattctggacacgttccagacttggcaaattatttgaagaatgctgttactacctccggaagctatatggcattagtccacatttttttcttattaggggagggtataagtcacggtaatgtgaaaagtatggagaaaccttaccccaaaatattttcatgcagcggacaaatactaagactctgggacgacctagggacatcaaaggaggaacaagataggggcgataacgcatcttccattccgcttttcatgaaggaaaaaaatttgccgtctgaaggagaggctagagaatgcattatgcagttaataggaaacttatggaaagaattaaacactgaacttttatcctcctcctggccgttacctattataagggcatgttttaacatgtctagaactagccaagtaatttatcaacatgaagaggatagctactcatccggggtggataactttgttaaatttttactgctagaaccaataggctta

SEQ ID NO: 1037 - DNA, 1542 bp, Olea europaea
atgaaggtgcttcatacaatggaaaatataaattgttctaaacgtatcgaggaactacaagaaaatacgaggaaggctctacaaagagcgttagacccaatggccgctatggaacttatcgatacactacaatggctaggaattgcctataattacgaagaagaaattgattcatggttaaataagttaattaactgggatgctggggacgacttacacgcaactggtcttcgttttcgtcttctcaggacagaaggcctcccagtttcctgcgatgttttcaaaaagttcatggaaaaaaatggtaagtttaaggagtctatttctcaagatacacgaggtttgttaagtttatacgaggcctcatctttgggtgcatctggtgaagatatcctctccgaagcaatgcgttttgccgttacccagctgagattatccatgccttcaatggggaagcaattatgtagacaggtaacacgtgcgttggagttacccagacatcttagaatggcacggcttgagtctaggttatatatagatgagtactcaatgggttctaacttcaaccagatacttttagagcaggccaaattagattataataaggtccaatcacttcatcaaatcgaattagccgaactaagtagatggtggaaacaacttggtttagtagagaaattaaaatttggtagagatcgtccgatggaatgttatttttggacggtcggaattttgccagaccctaaatacagtcagccgcgtatcgagttagcaaaaactatagccatcttattggtcatcgacgacatattcgacacctacggtagtattaacgaactcgtgctgttcaacgacgctatccaaaaatggaatttagatgcaattgaacctcttcctgcttacatgaaaatttgttatatggctttgtacaataccacgaacgaaatagcttacaacattcttaaagaacagggtcgaaatgtcctgccatcgttgaagagggtctggatgaatactatcgaagcttttatgatagaagctaactggtttaacagtggtcatgtccccaatctagcaaattatttgaagaatgctgttacgacctcagggtcttacatggctttagtgcatattttcttcttactcggcgaagggattagccatgggaacgtcaaatctatggaaaaaccctatccgaagatttttagttgttccggacaaatactgaggttgtgggacgaccttggcacgtcaaaggaggaacaagatagaggcgataacgcttcaagcataccattattcatgaaagaaaaaaatttggcttcagaaggagaagctcgagaatgtattatgcagttgattggtaacttgtggaaagaattgaacacagaacttctaagttctagtctgccactacccataatcagagcgtgctttaatatgtctagaacttcagaggttatatatcaacatgaggaagactcttactcatctggtgtcgacaattttgtcaaattcttattgctcgaaccgatcggcttg

SEQ ID NO: 1038 - DNA, 1479 bp, Catharanthus roseus
atggattacctgactataatacttacacttctcttcgctctaactctttacgaagctttttcttatttatcacgaagaactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactcta

SEQ ID NO: 1039 - DNA, 1479 bp, Catharanthus roseus
atggattaccttaccataatattaactttactatttgccttgactctctatgaagccttcagctacctatccagaagaaccaaaaaccttcctccaggaccatcgccattgccgttcatcggaagcctccatttattaggcgaccaaccacacaaatccttagcaaaactttccaaaaaacacggtccaattatgagtctcaaattaggccagatcactacaatcgtcatatcttcatcaacaatggcgaaagaagttcttcaaaaacaggatttagcattttcaagcagatcagttccaaacgcactccacgctcacaatcaattcaaattctccgttgtatggcttccggtagcctcacgatggagaagtcttcgaaaagttttgaattctaatatattttccggcaatcggctcgacgctaatcaacatttgagaactagaaaagtacaggaactaattgcgtattgccggaaaaatagccagagcggagaagcggttgacgtcggccgagctgcttttagaacttcgttgaatttgttgtcgaatttgattttttcaaaggatttgacggatccttattcggattctgccaaggaattcaaggatttggtttggaatataatggttgaggcggggaaacctaatttggtcgatttttttcccctgcttgaaaaagttgatcctcaaggtatacgacatcgtatgacgattcactttggggaagttcttaagctttttggtggacttgttaatgaaagattggagcaaagaagatcaaaaggggaaaaaaatgatgtgttggatgtacttctaactaccagccaagaaagccctgaggaaatcgatagaactcacattgagcgaatgtgcttggacctgtttgtagcagggacggacacaacatcaagcacattagaatgggcaatgtcagaaatgcttaaaaacccagacaaaatgaagaaaacccaagatgaacttgcacaagtaatcggcagaggaaaaacaatagaagaatccgatattaaccgcttaccttacttaagatgcgttatgaaagaaaccttaaggatacatccaccagttcccttcttaattcctcgcaaagtggaacaaagtgttgaggtttgtggatacaatgtccctaaaggatcacaagttcttgtgaatgcttgggcaattggacgtgatgaaactgtttgggatgatgctttggcattcaaacccgagagatttatggaatctgaattggatatccgtggaagagatttcgagctgattccgttcggtgctggccgaagaatttgcccagggttgccattggcactaaggactgtgcctttgatgcttggttctttgttgaactcttttaattggaagcttgaaggtgggatggctccaaaagatttggatatggaggagaagtttggtattacactgcagaaggctcatcctttgcgtgctgtaccaagcacccta

SEQ ID NO: 1040 - DNA, 1479 bp, Catharanthus roseus
atggattatctgactatcattttgacgttactttttgctctaactctgtatgaggctttctcatacctaagcaggagaacgaagaatcttccccccggtccatcacccctaccatttatcggctcacttcatttgctgggtgaccagcctcataaaagccttgcgaagctttccaaaaaacatggtccgattatgtcattaaagttgggccaaatcacaacaattgttatttctagttccacgatggctaaggaggtcctacaaaaacaagacctggcctttagttccagatccgtaccgaacgctttacatgcgcataaccagttcaagttcagtgtggtgtggctgccggttgcctccaggtggcgtagccttaggaaagttctaaacagtaacatattcagtgggaacagactggatgccaaccagcatctaagaactcgtaaagtgcaagaattgattgcttactgtaggaaaaactctcagtctggtgaagcagttgatgttggacgtgcggcttttcgtacgagccttaatctattatccaatcttattttctccaaagacctgaccgacccctattcagatagtgcgaaggaattcaaagaccttgtgtggaatatcatggtcgaagcagggaagcctaacctagtcgacttcttcccgttattagagaaagtcgacccgcagggtattcgtcataggatgacgattcactttggagaggttttaaagttgttcggcggtcttgtaaatgagagactagaacagagacgttcaaaaggagagaagaatgacgtactagatgttcttttaaccacatcacaggagtctcctgaggagatagacagaactcacattgagcgtatgtgtctagatctatttgttgcgggcactgacacaacttcatctactttagagtgggcgatgtcagagatgttgaagaaccccgacaaaatgaagaagacccaggacgaactggctcaagttattggtagaggcaaaaccattgaggaaagtgatatcaataggttgccgtacttacgttgtgtcatgaaagagactctgaggatacatccgcctgtaccattcctaattcctagaaaggtggagcaatccgtagaggtttgcggatacaacgtcccgaaagggagtcaggttttagtcaacgcatgggctattggacgtgatgaaacggtttgggatgatgctctggctttcaaaccggaaagatttatggagtccgagctagatatcagggggagagactttgaattgattccttttggagccggtagaaggatatgccctgggttgcccctggcccttagaacagtccccctaatgctgggttctctattaaattcatttaattggaagttggagggaggcatggctcccaaagatctagatatggaagaaaagtttggaatcacgttgcaaaaggcccatccactacgtgctgtcccatccacgtta

SEQ ID NO: 1041 - DNA, 1479 bp, Catharanthus roseus
atggattatttaacaattattctgacacttttgtttgcattaaccttgtatgaggcctttagctaccttagcaggcgtacaaagaatcttccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1042 - DNA, 1479 bp, Catharanthus roseus
atggactatctgaccatcatcctgaccctgctgttcgccctgaccctgtatgaggccttctcctatctgtcccggcggaccaagaacctgccccccggcccctcccccctgcccttcatcggctccctgcacctgctgggcgaccagccccacaagtccctggccaagctgtccaagaagcacggccccatcatgtccctgaagctgggccagatcaccaccatcgtcatctcctcctccaccatggccaaggaggtcctgcagaagcaggacctggccttctcctcccggtccgtccccaacgccctgcacgcccacaaccagttcaagttctccgtcgtctggctgcccgtcgcctcccggtggcggtccctgcggaaggtcctgaactccaacatcttctccggcaaccggctggacgccaaccagcacctgcggacccggaaggtccaggagctgatcgcctattgccggaagaactcccagtccggcgaggccgtcgacgtcggccgggccgccttccggacctccctgaacctgctgtccaacctgatcttctccaaggacctgaccgacccctattccgactccgccaaggagttcaaggacctggtctggaacatcatggtcgaggccggcaagcccaacctggtcgacttcttccccctgctggagaaggtcgacccccagggcatccggcaccggatgaccatccacttcggcgaggtcctgaagctgttcggcggcctggtcaacgagcggctggagcagcggcggtccaagggcgagaagaacgacgtcctggacgtcctgctgaccacctcccaggagtcccccgaggagatcgaccggacccacatcgagcggatgtgcctggacctgttcgtcgccggcaccgacaccacctcctccaccctggagtgggccatgtccgagatgctgaagaaccccgacaagatgaagaagacccaggacgagctggcccaggtcatcggccggggcaagaccatcgaggagtccgacatcaaccggctgccctatctgcggtgcgtcatgaaggagaccctgcggatccacccccccgtccccttcctgatcccccggaaggtcgagcagtccgtcgaggtctgcggctataacgtccccaagggctcccaggtcctggtcaacgcctgggccatcggccgggacgagaccgtctgggacgacgccctggccttcaagcccgagcggttcatggagtccgagctggacatccggggccgggacttcgagctgatccccttcggcgccggccggcggatctgccccggcctgcccctggccctgcggaccgtccccctgatgctgggctccctgctgaactccttcaactggaagctggagggcggcatggcccccaaggacctggacatggaggagaagttcggcatcaccctgcagaaggcccaccccctgcgggccgtcccctccaccctg

SEQ ID NO: 1043 - DNA, 1554 bp, Catharanthus roseus
atgtctgctaccaagtcaatcgttggagaggcattggaatacgtaaacattggtttaagtcatttcttggctttaccattggcccaaagaatctctttgatcataataattcctttcatttacaatattgtatggcaattactatattctttgagaaaggaccgtccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1044 - DNA, 1488 bp, Catharanthus roseus
atggagttgttaaagcttctgtgtttgattttatttcttactctttcctatgtcgcctttgcaatcattgtcccacctctaaactttcccaaaaatataccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1045 - DNA, 1605 bp, Catharanthus roseus
atgagttctgtcgcagaaaatataatacaacatgccactcataattctacgctacaccaattggctaaagaccagccctctgtaggcgtcactactgccttcagtatcctggatacacttaagtctatgtcatatttgaaaatatttgctactttaatctgtattcttttggtttgggaccaagttgcatatcaaatcaagaaaggttccatcgcaccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1046 - DNA, 1614 bp, Catharanthus roseus
atgcagtacaaactggcgttaaatggtaaaactctaaaaggagagacaactacagaagcagtcgacgccgctacggctgaaaaggtctttaaacagtacgcaaatgataacggagtcgacggggaatggacgtacgacgatgcgacaaaaacgtttactgttaccgagggcggtggatctttgtatgaggcctttagctaccttagcaggcgtacaaagaatcttccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1047 - DNA, 1440 bp, Catharanthus roseus
atggcattgtatgaggcctttagctaccttagcaggcgtacaaagaatcttccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1048 - DNA, 1458 bp, Catharanthus roseus
atggcgttattactggctgtatttttgtatgaggcctttagctaccttagcaggcgtacaaagaatcttccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1049 - DNA, 1569 bp, Catharanthus roseus
atgcagtacaaactggcgttaaatggtaaaactctaaaaggagagacaactacagaagcagtcgacgccgctacggctgaaaaggtctttaaacagtacgcaaatgataacggagtcgacggggaatggacgtacgacgatgcgacaaaaacgtttactgttaccgagggcggtggatctccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1050 - DNA, 1395 bp, Catharanthus roseus
atggcaccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1051 - DNA, 1413 bp, Catharanthus roseus
atggcgttattactggctgtatttccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctacttta

SEQ ID NO: 1052 - DNA, 1476 bp, Nepeta cataria
atggatttcctcacaatcttcattggaccattacttgccatcatcgccttattctatgcacgcttaacaatctccacgaggggcaaaaacctgcccccggggccgacgccgcttcccttcatcggaaacctccatttgctcggccaccacccccacaagtccctcgcccgtctggccaagacttacggcccactcatgctcctccgcctcggctccgaaaacaccgtcgttgtctcctccgccgccgtcgctaaagaagtcctccagaagcatgacctcgccttctccagcaggagcatccccgacgccgtccatgctcacgaccagttcaagtactccgtcgtttggctcccggtggcctcgcggtggcgcagcctccgcaaaaccatgaactccaacatcttctccggcagctgcctcgacgccaatcagcatcttaggagcaggaaggtggaggagctcattgcctactgcaaggaaagctgccggagggcggaagccgtcgacgtcggccgcgccgccttcagaaccgccttgaactcgctctccaacaccatattttcgagggatttggccgatccgttgtcggattccggtaaggaattcaaggatgtggtgtcgagtatcatgatggaggcagggaagcccaactccgtggattactatccttttttatcaagatttgatccacaaggaatacgacgtcgcaccgctatctatttcgacaaattgatcaatattttcaaaggtttgatcgatgaaaggttggagaaaagaagatctcaatacgaagaagcaactgatgttatcgatatcctcctcaacaccatcgagcaaaaccccgaagagatcgaccgaactcacatcgaacgaatgtttttggatctgttcttggcgggaacggacacaacttcgagcacagtggaatgggcaatggcggaggcgatgaaaaatccagaaacaatgaagaaagccaaggcagagctagcacaagtgatcggaaaaggaaaaatagtacaagaaaccgacataccgcatctgccatatctgcaatgcattgttaaagagacgctgagactacacccgccggttcccttcctcattccacgcagagtccacgaagacgtcgacatcttgggctacgtcgtgcccaataactcgcaggtcttcgtgaacatgtgggccatcgggcgggaccccgatatgtggaaaaaccctctacagttcgaccccgaccgcttccacgattcggaggtggggttgagggggaaagatttcgagctgattccattcggcgcgggcagaagaatctgcccggggctgccgctggcgatgagaatggtgcccgtagtgctggggtcgcttctgaattcattcgactggaaagtggaaggagggaaggaattagagatgaatgagaagtttggaatcacgttggagaaggctcaaccacttatggctgtccctatcgctctt

SEQ ID NO: 1053 - DNA, 1470 bp, Nepeta mussinii
atggatttcctcacaatcacagttggattagtatctgcaatcatcatcaccttcatctatggattctccttgtcccggagaggcaaaaacctcccgccggggccgacgccgctgccgctcatcggaagcctccatttgctcggcggccaaccacataaatccctcgcccgtctcgccaacatctacgggcccctcatgcgcctccgcctcggctccgtaaacaccatcgtcgtctcctccgctgccgtcgctcgagaagtcctccagaagcacgacctcgccttttccagcaggagcatccccgacgccctccatgctcacgaccacttcaagtactccgtcgtctggcttccggtggcctcgcggtggcgcagcctccgcaaaaccatgaactccaacatcttctccggcagccgcctcgacgccaaccagcacctcaggagtaggaaggtggaggagctcgttgactactgcagggaatgcagtcggaccgcggaggccgtccacgtcggccgcgccgctttccgaacagtcctgaactcgctgtctaacaccatattttcgaaggatttggccgatccgttttcggattctgggaaagaattcaaggaaattgtttctaacatcatgaaggaggcgggaatgcctaatctggttgatttctttccttttttagcaaggtttgacccccaaggaatacggcgtcgtactactgtttacttcggcaagattatccatctcttcagcggattgattcaagagaagttggagaatacaaatcaggaagaaaatattgatgtaatccaaatcctcctcaacactagtcgtcaaagcccccaagagatcgaccggactcacatcgagagaatgtgtttggatctattcgtggctggaacagacacatcttcgagcacagtggaatgggcaatggcggaggcactcaaaaatctagaaaccatgaagacagcgaaagtcgagctagaacaagtgatcgggaaagggaaaacaatacaggagactgatgtatcgcgtctgccatacctgcagtgcatggttaaggagacgctgagactccacccaccagttcccttcctaatccctcgtacagtggaccaagacgtcgaggtgttgggccacgtagtgcctaaaaactcacgagtctttgtgaacatgtgggccatcgggcgggatcccgacgtatgggaaaacccattagagttcaatccccgccgttttctcgattcagaggtggacgtgcggggcacaaattttgagttgattcctttcggagcgggtaggagaatctgtccggggctgccgctggcgatgagaatggtgcccgtaatgttggggtcgcttctaaattcatttgattggaagctggaaggaggagagaatttggatatggatgagaagtttggaataacgttagagaaagcccagccgttgagggttgttcctatctctctc

SEQ ID NO: 1054 - DNA, 1476 bp, Nepeta cataria
atggatttcctgactatctttatcggaccgttacttgcgatcatagctctgttctacgcgagattgacaatcagtacgagaggtaaaaacctacctcccggtcccaccccgctaccttttattgggaatttgcatttattaggacatcacccccataaatccctagcccgtctggcaaaaacctatggcccgttaatgttgcttagattgggatcagaaaacaccgtagtagtctcatcagccgccgtggccaaagaagttttgcagaaacacgacttagctttcagctcaaggagtataccagacgcagttcatgcacatgaccagttcaagtatagtgtggtctggctaccggtggctagccgttggcgttcacttagaaagactatgaattctaacatcttttctggaagctgccttgacgccaatcagcatctaagatcacgtaaggtcgaagagcttatagcatactgtaaggagtcatgtaggcgtgccgaggcggtggacgtcggcagggcagcttttaggaccgctcttaactcactttctaacacaatttttagcagagacctagcggatccgttatccgattcaggtaaggagtttaaagatgttgtgagctccataatgatggaggcggggaaacccaatagcgtagactattacccttttctgtccaggtttgacccccaaggtatcagaagacgtacagcgatatactttgacaagttaattaacatttttaaggggctaattgacgagagactggaaaaaaggaggtcccaatacgaggaggcaacggacgtaattgatatactactgaataccattgaacagaaccctgaagagattgataggacacatatcgaacgtatgtttttggatctttttcttgccggcactgacaccacctcctctaccgtggaatgggccatggcagaggctatgaagaaccccgaaactatgaagaaggcaaaagctgaactggcgcaagtcatcggtaaggggaagattgtacaagagacagatataccccatctaccctatcttcagtgcattgttaaggagacgttgagattacacccaccagtcccatttttgattccgagacgtgtacatgaagatgtagatattctgggatacgtagtcccaaacaactcacaggtatttgtgaatatgtgggctatcggacgtgatcctgatatgtggaagaatcctctacagttcgatcctgacagattccacgatagtgaagtcggactgaggggcaaggattttgagcttattccctttggagctggaagaagaatctgcccaggcttacctcttgcaatgaggatggttccggtggtgttgggatctctactaaacagctttgactggaaggtagaaggcgggaaggagcttgaaatgaatgaaaagttcggcatcactctggagaaggcccagccactgatggcggttccgatcgccttg

SEQ ID NO: 1055 - DNA, 1470 bp, Nepeta mussinii
atggattttttgaccatcactgttggacttgtatccgccattattataacgttcatctacggcttttcactatcccgtagggggaagaatctgccgccaggtcctacaccgttaccgttaattggctcattacatctattagggggacagccgcacaaaagtctagcacgtcttgccaacatatatggacctctgatgagattacgtcttggatccgtgaacaccatcgttgtttcctctgccgccgtcgctagagaagtactacagaagcatgatcttgctttcagctcaagatcaattcctgacgcgcttcatgcacacgaccatttcaaatactcagtagtttggcttcctgttgcctctaggtggagatcattacgtaagacgatgaactctaacattttcagtggcagtcgtctggatgctaatcaacatcttcgttctcgtaaggttgaggagcttgttgactattgcagggaatgcagcaggaccgcggaagctgttcacgtaggacgtgccgcttttagaactgttcttaactcactttctaataccatcttttctaaagacttagccgatcccttttccgacagcggaaaggagttcaaagaaatagtttcaaacattatgaaagaagctgggatgccaaacttagttgactttttcccattcttagccaggttcgatccgcaaggaatccgtagaaggacaacggtgtatttcggaaagattatacatctattcagcggtctgattcaggaaaagctagagaatacgaaccaggaagagaatatagatgtcatacagatactacttaacacctcaagacaatctcctcaagaaattgatcgtactcatatagaaagaatgtgcttagatctgttcgtcgccggcacagatacgtctagctccaccgttgagtgggctatggcagaggcgctgaagaatttagagactatgaagacggcaaaagtggaacttgagcaggttataggaaagggtaaaactattcaggaaacggacgtttcaaggttgccgtatttgcaatgtatggtaaaggagaccctgaggctgcaccctcctgttccttttttgattccacgtaccgtggatcaggacgttgaggtacttggtcacgtggtgcccaaaaattctcgtgtgttcgtcaatatgtgggcgatcggcagggaccctgatgtgtgggagaaccctttggaattcaatccaagaagattcctggacagtgaggtagacgtgagaggaacaaattttgaattgatcccgttcggagcgggaaggcgtatttgtccaggtctaccgttagccatgaggatggtgcctgttatgcttggtagcttattaaactcctttgattggaaattagagggcggggaaaacctggacatggacgagaaatttgggatcacgcttgagaaagcacagccgctgagagttgtgccaatttcactt

SEQ ID NO: 1056 - DNA, 1476 bp, Nepeta cataria
atggattttttgactattttcattggcccattattagcaataattgcactattttacgccaggttaaccattagcactcggggtaagaatttaccaccaggtcctactccactaccttttattggtaatttacatttgctaggtcatcacccacataagtctttggcgagacttgctaaaacttatggaccgttgatgctgctaagattagggtctgaaaatactgtagtagtgagttctgcagccgttgcaaaggaggtattacaaaagcatgatttagctttttcatctagatccataccagatgcggttcatgctcacgatcagttcaaatactctgtcgtctggttacctgtggcatctcggtggcgatcacttagaaaaactatgaattcgaatattttcagcggttcatgcttagatgctaatcaacatttgcgaagtagaaaagttgaagaattgatagcgtattgcaaagaaagttgccgtcgagctgaggctgtcgatgttggaagagctgcattcagaactgctttgaactccctgtccaacaccattttctcgagggatctggcagatcctctgtccgactctggaaaagaatttaaggatgttgtatcttccataatgatggaagcaggcaaacctaacagtgtagactattacccctttctatccagattcgatccccagggaataagaagacgtactgccatttattttgataaattaataaatattttcaaagggttgattgacgagagattggaaaaacgtaggagtcagtacgaggaagcgacagacgtcattgacatacttttgaacacaatcgaacaaaacccggaggaaatcgaccgtactcatattgaaaggatgtttttggacctatttcttgccggtacagatacgaccagtagtacggtcgagtgggccatggctgaggccatgaagaacccggaaactatgaaaaaagctaaagctgagctggcacaggtaattggcaaaggtaaaattgtacaagaaactgatatcccacatttgccatatttgcaatgtattgtgaaggaaactcttcgcttacatccgccggtcccatttcttatacctcgacgcgtacatgaagatgttgacatcttgggttatgttgttcctaataactcacaagtattcgtcaacatgtgggccattggccgcgatccagatatgtggaagaatccactacaatttgatcctgatagattccatgattcagaagtgggtctaagaggtaaagacttcgaacttataccatttggtgctgggcgtagaatctgcccaggattacctttagcaatgagaatggttccagttgttttgggctcactattgaattcatttgattggaaagtcgaaggcggcaaggaattggaaatgaacgaaaagtttggtatcacattggaaaaggcacaacccttgatggcggtaccaattgcacta

SEQ ID NO: 1057 - DNA, 1470 bp, Nepeta mussinii
atggattttttaactattactgttggtctggtcagcgctattattattactttcatctacggtttctcgttgtcaaggagaggaaaaaatttaccacctggcccaacccctctgccattgataggttccctgcatcttttaggcggtcagccccacaaatctttagcgaggctagcaaatatatacgggcctttgatgagattgagattgggttccgtaaatactattgttgtcagttccgctgctgttgcacgggaagtcttacaaaaacatgatctggccttttcctctaggagcatccccgacgctttacatgctcatgatcacttcaagtattctgttgtatggttgcctgtagcatcccgatggcgaagtctgagaaagacgatgaactccaacatcttttctggttcaagactagatgctaaccaacatttgcgttcgagaaaggttgaagagttagttgactattgcagagagtgttctcgaactgcagaagctgtgcatgtcggaagagcagcatttaggactgttcttaacagtctgagcaacacgatttttagcaaagatctggccgatcctttctctgacagtgggaaggaattcaaagagattgtcagcaatatcatgaaagaagccggtatgcccaatctagtcgatttctttcctttcttggcacgttttgatccgcagggaatccggagaaggacaacagtttattttggaaagatcattcatttatttagcggcctgatacaggaaaagttggagaacaccaatcaagaagagaatatagatgttatccaaattctgttaaatacaagtcgtcagagtccacaggaaatcgatcgcacacatatcgaacgtatgtgtctagatttgtttgtcgcgggtacggataccagctcttcaacagttgaatgggcgatggccgaagcattaaaaaatttggagaccatgaaaactgccaaggtcgaattagaacaagttattgggaagggcaaaacaatccaagaaacagatgtaagtaggctgccctatttgcaatgtatggttaaggaaacgttacgcctgcatccacctgtgccattccttattccacggactgtggaccaagatgtagaagtcttaggtcatgtcgtacctaagaatagcagagtctttgtaaatatgtgggcgatcggcagagaccctgacgtttgggagaatccattggagtttaacccgagacgtttccttgactctgaagtcgatgtacgtggcaccaacttcgaattgattccatttggggcgggcagaagaatttgtcctggcctgcctttagcgatgagaatggtgcctgttatgctgggttctttgttaaactcatttgactggaagctggaaggcggcgagaacctggacatggacgaaaagttcggaattaccctagaaaaggctcaacctttgcgtgttgttccaatttcctta

SEQ ID NO: 1058 - DNA, 1476 bp, Nepeta cataria
atggacttcctgaccatcttcatcggccccctgctggccatcatcgccctgttctatgcccggctgaccatctccacccggggcaagaacctgccccccggccccacccccctgcccttcatcggcaacctgcacctgctgggccaccacccccacaagtccctggcccggctggccaagacctatggccccctgatgctgctgcggctgggctccgagaacaccgtcgtcgtctcctccgccgccgtcgccaaggaggtcctgcagaagcacgacctggccttctcctcccggtccatccccgacgccgtccacgcccacgaccagttcaagtattccgtcgtctggctgcccgtcgcctcccggtggcggtccctgcggaagaccatgaactccaacatcttctccggctcctgcctggacgccaaccagcacctgcggtcccggaaggtcgaggagctgatcgcctattgcaaggagtcctgccggcgggccgaggccgtcgacgtcggccgggccgccttccggaccgccctgaactccctgtccaacaccatcttctcccgggacctggccgaccccctgtccgactccggcaaggagttcaaggacgtcgtctcctccatcatgatggaggccggcaagcccaactccgtcgactattatcccttcctgtcccggttcgacccccagggcatccggcggcggaccgccatctatttcgacaagctgatcaacatcttcaagggcctgatcgacgagcggctggagaagcggcggtcccagtatgaggaggccaccgacgtcatcgacatcctgctgaacaccatcgagcagaaccccgaggagatcgaccggacccacatcgagcggatgttcctggacctgttcctggccggcaccgacaccacctcctccaccgtcgagtgggccatggccgaggccatgaagaaccccgagaccatgaagaaggccaaggccgagctggcccaggtcatcggcaagggcaagatcgtccaggagaccgacatcccccacctgccctatctgcagtgcatcgtcaaggagaccctgcggctgcacccccccgtccccttcctgatcccccggcgggtccacgaggacgtcgacatcctgggctatgtcgtccccaacaactcccaggtcttcgtcaacatgtgggccatcggccgggaccccgacatgtggaagaaccccctgcagttcgaccccgaccggttccacgactccgaggtcggcctgcggggcaaggacttcgagctgatccccttcggcgccggccggcggatctgccccggcctgcccctggccatgcggatggtccccgtcgtcctgggctccctgctgaactccttcgactggaaggtcgagggcggcaaggagctggagatgaacgagaagttcggcatcaccctggagaaggcccagcccctgatggccgtccccatcgccctg

SEQ ID NO: 1059 - DNA, 1470 bp, Nepeta mussinii
atggacttcctgaccatcaccgtcggcctggtctccgccatcatcatcaccttcatctatggcttctccctgtcccggcggggcaagaacctgccccccggccccacccccctgcccctgatcggctccctgcacctgctgggcggccagccccacaagtccctggcccggctggccaacatctatggccccctgatgcggctgcggctgggctccgtcaacaccatcgtcgtctcctccgccgccgtcgcccgggaggtcctgcagaagcacgacctggccttctcctcccggtccatccccgacgccctgcacgcccacgaccacttcaagtattccgtcgtctggctgcccgtcgcctcccggtggcggtccctgcggaagaccatgaactccaacatcttctccggctcccggctggacgccaaccagcacctgcggtcccggaaggtcgaggagctggtcgactattgccgggagtgctcccggaccgccgaggccgtccacgtcggccgggccgccttccggaccgtcctgaactccctgtccaacaccatcttctccaaggacctggccgaccccttctccgactccggcaaggagttcaaggagatcgtctccaacatcatgaaggaggccggcatgcccaacctggtcgacttcttccccttcctggcccggttcgacccccagggcatccggcggcggaccaccgtctatttcggcaagatcatccacctgttctccggcctgatccaggagaagctggagaacaccaaccaggaggagaacatcgacgtcatccagatcctgctgaacacctcccggcagtccccccaggagatcgaccggacccacatcgagcggatgtgcctggacctgttcgtcgccggcaccgacacctcctcctccaccgtcgagtgggccatggccgaggccctgaagaacctggagaccatgaagaccgccaaggtcgagctggagcaggtcatcggcaagggcaagaccatccaggagaccgacgtctcccggctgccctatctgcagtgcatggtcaaggagaccctgcggctgcacccccccgtccccttcctgatcccccggaccgtcgaccaggacgtcgaggtcctgggccacgtcgtccccaagaactcccgggtcttcgtcaacatgtgggccatcggccgggaccccgacgtctgggagaaccccctggagttcaacccccggcggttcctggactccgaggtcgacgtccggggcaccaacttcgagctgatccccttcggcgccggccggcggatctgccccggcctgcccctggccatgcggatggtccccgtcatgctgggctccctgctgaactccttcgactggaagctggagggcggcgagaacctggacatggacgagaagttcggcatcaccctggagaaggcccagcccctgcgggtcgtccccatctccctg

SEQ ID NO: 1060 - DNA, 1503 bp, Vigna angularis
atggaaacaaatagcaccctgttttttacgttcacggtgcttttgattacgattataaccttcttaaaggctctgaaatccctgttcacccctaataagtcaaaaagtaatcttcctcccggacctaagggcctaccactagttggaaacctattgcaactaggcgccaaaccacatcagactctggccacgcttgcaaatatacatggaagcattatgagcttaaaacttggacaggagacgactatagtaatgtcatcagctgaggccgcaaaaggcgtacttcaaatccacgaccatttcctgagtaatagaaaaattcctgatgctatgagaggatcaagccacgatcacttctcattgccatttatgccggtaagtcaacaatggagggagttaaggaagctgtgtaacgagttgttattctctaataagaatctggatgcgacgcaggggttaaggtctaagaaggtgagagagctatactctgatatacaccgtagcagtctgaaaggggaacccgttaatattggcagactagccttcaaaacaactatcaaccagctaagcaataccatatatagtgaagacttccttcagagtgctgagaaggcaggtgaaatgaaggaactggtcacgaacatcatgaaagaggttgggaggccaaatcttgcggactgctttccggtattaaaaatgatagacccccatggcattagaaggcgtactggaagctacttctccaaactgttgaatatatttaaatcccttatccataagaggctggagctgcgtaaggatgcagcgggttactgcaccaaaaaagatatgctggacgctatgctgaatgatgcccaacacaagatggatattgtcaaaatacagaggttgtcacttgatttatttgtagctggtacagataccgtaacttccaccgtggaatgggccatggcggaactattacacaacccccacgtcatgtcaaaggccaaagaggaactggagaggattattgggaaagacaatttggtggaggaatccgatatcgcgaagctaccgtatcttcaggcgattgttaaggaaactttcagactgcaccctgcggtcccattactactgccaaggaaagccgaggtggaattcgagatgcacgggtacacgattccaaagggggctcaggttttaatcaatgtttgggcgattggcagggaccccaatctatgggagaagcctagattgttctggccagaaagatttttagaatcagagatagattttaaggggcgtagctttgaattgactcctttcggcggggggaggagaatttgtcccggcctgccattagcgattagactggtgttccttatgttgggcctattcataaacagcttcgattgggaactgcaagatatacagcctgaggatatgaacatggacgaaaactttgggctgaccttagagaaagcacagccggttttagcaatccctattatccctaagcac

SEQ ID NO: 1061 - DNA, 3144 bp, Bacillus megaterium
atgacgattaaggaaatgccgcaaccgaaaacatttggggagctgaagaatctgccgcttcttaacacagataaacctgtacaggctcttatgaaaatcgctgatgagcttggtgaaatttttaagttcgaggcaccaggaagagttacaaggtacctgtccagccaaaggctgattaaggaagcgtgtgatgagtcaaggttcgataagaatagactatggcccactgtgcccctgttttctttatacgccaaagaagatacagtctggacccacgaaaaaaactggaaaaaggctcataacatactgttaccttcatttagccagcaggcaatgaagggttaccacgctatgatggtcgacatcgccgtccaattagttcaaaagtgggagaggttaaacgcagatgaacacattgaagtgcctgaagatatgacccgtttgaccttggacacaatcgggttatgcgggttcaactatagatttaattccttctatagggatcagcctcacccctttatcacatccatggttcgtgcgttagatgaggccatgaataagctacagagggcaaacccggatgaccccgcatacgatgaaaataagagacaattccaagaagatataaaggtcatgaacgacctggttgacaaaatcatagccgacaggaaagcgagcggggaacagagtgatgaccttctaacccatatgttaaatggaaaagacccagagactggcgagccgttagacgacgagaatatccgttatcaaattattacgtttcttattgcgggccacgaaactacttcaggactattatcctttgctctgtactttttagtgaaaaaccctcacgttctacagaaggccgcagaggaagcagcgagggtattagttgatcctgtaccctcttataaacaggtaaagcagttaaaatacgtggggatggtgcttaacgaagctttaaggctttggccgacagcgccggccttctccctttacgcgaaagaagacactgtcctagggggtgagtatccgcttgaaaaaggagacgagttaatggtcttgattccgcagttacatcgtgacaaaacaatctggggagatgacgtggaggagttccgtccagaacgtttcgaaaatccatccgcaatcccccaacacgcattcaaacccttcggcaatggccaacgtgcctgtattggacagcagtttgcgttacacgaggctacgttagtccttggtatgatgttaaagcacttcgactttgaggaccatactaactatgaactggatattaaagagacgttaacgctgaagcccgaaggttttgtggtaaaagctaagtccaaaaagataccactgggcggaataccgtctccctcaaccgaacaatccgctaaaaaggtcaggaaaaaagccgaaaatgcacacaacactccactgttagtattatatggttctaatatgggcacggctgagggtactgcccgtgacctagccgacattgctatgagcaaaggctttgccccacaagtggccacgcttgatagccatgctggaaacttgcctcgtgagggtgccgtcctgatagtcacggctagttataacggacaccctcccgataatgccaaacaatttgtagattggttggaccaggcgtctgccgacgaggttaaaggcgtgagatattctgtatttggctgtggcgataagaattgggcaacgacgtaccaaaaggtacccgcatttatcgacgagactttggctgccaagggtgcggagaacattgctgataggggggaggcagatgcatcagacgatttcgaaggcacttacgaagaatggagggaacatatgtggtcagatgtggctgcttactttaacctagacatcgaaaacagcgaagataacaagtccacgttatccctgcaatttgtcgactcagcggcagacatgccgctagccaaaatgcatggtgccttctccactaatgtggtggcgagtaaagagctacagcagcctgggagcgcccgtagtacgagacaccttgaaatcgaattaccaaaagaagcctcctatcaggaaggggatcacttaggcgtcatcccaagaaactatgaaggaatcgtaaaccgtgtgacagccaggttcgggctagacgcaagccaacaaatccgtttggaggctgaagaagagaaactggcccatctgcctttagcaaaaacggtcagtgtagaggagttgctacagtatgtagaactacaagatcccgtgacaagaacacaattacgtgctatggccgcgaagacagtgtgtcccccacacaaggtagagcttgaagctttgttagaaaaacaggcgtacaaggaacaggttttggctaaacgtcttaccatgctggaactgttagaaaagtacccagcttgcgagatgaagttttcagagtttattgcgcttttaccgagtattaggccgaggtattattctattagcagctcaccgcgtgttgacgaaaagcaagccagtattactgtcagcgttgtgtcaggcgaggcctggtctggttacggggagtataaaggcatcgcgtcaaactacctagcagagctgcaggagggagataccattacatgctttatcagtacaccacaaagtgaatttactctgccaaaagacccggaaacgccgcttatcatggtaggaccgggaacaggtgtagcaccttttcgtggtttcgtacaagccagaaagcagcttaaggagcaaggacaatcccttggtgaagcccacttatacttcggctgtcgttctccccatgaagactacctttaccaagaagaactagagaacgcacaatctgaggggattattacgctgcataccgcattcagtaggatgcctaatcagcccaagacgtatgtacagcatgtcatggaacaagatggcaaaaaactaattgaacttcttgatcagggtgcgcacttttacatctgtggagatgggtctcagatggcccctgccgtcgaagcgacgcttatgaagagctacgcggacgtccatcaagtatccgaggctgacgcgaggttatggttgcaacaactggaagaaaagggcaggtatgccaaagacgtgtgggcgggc

SEQ ID NO: 1062 - DNA, 3144 bp, Bacillus megaterium
atgactataaaggaaatgcctcaacctaagactttcggtgaattaaagaatttaccattgttaaataccgataagccagttcaagctttaatgaagattgctgatgaattgggcgagatctttaaatttgaagctccaggtagagtgactaggtatctttcctcacaacggctaattaaagaggcatgtgatgagtcgagatttgataaaaacagattgtggcctacagttcccttgttttccttatatgcgaaggaggatacggtatggacccatgaaaaaaattggaaaaaggctcataatattttactaccatcttttagtcaacaggcgatgaaaggttaccacgctatgatggtggacattgccgttcaactggttcagaagtgggaaagactaaatgctgatgagcacattgaagtccccgaagatatgactcgactgaccctggacactattggtttgtgcggtttcaactatagattcaactctttttacagagatcaacctcatccgttcataacctccatggtaagagcccttgatgaagcaatgaataaactgcagagggctaatccggacgatcccgcatatgatgaaaataaacgtcagttccaagaagacattaaggttatgaacgacttggtagacaagatcatagcagacaggaaggcatccggtgaacaatcagatgaccttctcacgcatatgttaaatggtaaggatcctgagacgggtgaaccgttagatgatgaaaatatccgataccagattattaccttcctaattgccggccatgagacaacaagcggtttgttatcttttgctttgtattttttggttaagaatccccatgtcttacaaaaggctgcagaagaagctgctagagtcctggtcgatccggtcccatcttacaaacaagttaaacaacttaagtatgtgggtatggttttaaacgaggccttgagactttggccaactgctccagcattttccttatacgccaaggaggacacggttttaggcggagaatatccattggaaaagggtgacgaacttatggttttaataccccaattgcatagagacaaaactatttggggtgacgacgttgaggaatttcgtccggagagattcgagaacccctccgctatcccacaacatgcgttcaagccttttggcaatggtcaaagagcctgtattggacaacagttcgccctgcacgaagccacactagtgctgggtatgatgctcaagcattttgactttgaggatcatactaactatgagttggatatcaaggaaaccttgactttaaaaccagaaggtttcgtcgtcaaagcgaaatctaaaaagataccacttgggggtataccatctccatctacagaacagagcgcaaaaaaagtgagaaagaaagcagaaaatgctcacaacaccccattattagtcctatacggtagcaacatgggtacagctgagggtactgcaagggatctagcagacatcgctatgtccaaaggttttgctccacaggttgcaaccttagatagtcatgccgggaatttacctagggaaggtgcagtgttgattgtaactgcttcgtacaatggacaccccccggataatgctaaacaatttgtagattggttagatcaagcttccgccgatgaagttaaaggagtacgttactcggtgttcggttgcggagataagaattgggcaactacttatcagaaggtccctgcgtttatcgatgagacgctagcggccaagggcgccgaaaatattgccgatcgtggtgaggcagatgcatcagatgacttcgaaggcacttatgaagaatggagagaacatatgtggtcagatgtcgctgcgtactttaatttagatatcgaaaatagtgaggataataagtctacattatccttacaatttgttgattcagctgctgatatgcctttagcaaaaatgcatggagctttctccaccaacgttgttgcttccaaggaactgcagcaacctggctctgctcgtagtacccgtcatttagaaatcgaacttccaaaagaagcaagttaccaagaaggagatcacttaggtgttattcctaggaattacgaaggcatcgtgaatagagtcaccgctcgttttggccttgatgcgtcccaacaaatcaggttggaggcagaagaggagaagctagcacacttgccacttgctaagacagtgtctgttgaggaacttttgcagtatgtcgaattgcaagacccagttacacgtacgcaactgagagctatggccgcaaaaactgtgtgtccgccacataaagtagagctcgaagccctgttggagaaacaagcatacaaggaacaagtacttgctaaaaggctaacgatgttggaactccttgaaaaatatcctgcttgcgagatgaaattcagtgaatttattgcattattaccttccataagacccagatactattccatctcctcatctccgagagtagatgagaagcaggcgagcattacagtatcagttgtgtccggtgaagcctggtctggttatggcgaatataagggcatcgctagtaattatttggcagagttacaagagggtgacacaataacttgcttcatctctacgcctcagtctgaattcacattgccgaaagatccagagacacctctgattatggtgggtcctggaaccggggttgctccctttcgtggttttgttcaagcgcgaaagcagctgaaagagcaaggtcaatccctgggcgaagctcatttatattttggatgcagatctcctcacgaagattacttgtatcaagaagagctcgaaaacgcgcaatctgaaggtatcattacgctccatactgcattctcaagaatgccaaaccagccaaagacctatgttcagcatgtaatggaacaggatggtaagaaattaattgagttattagaccaaggtgcccatttctatatatgcggggacggtagtcaaatggctccggcggtggaagctacactgatgaagtcatatgcggatgtccatcaagtgtcagaagctgatgcaaggctgtggttgcaacaacttgaggaaaaaggaagatatgcaaaagatgtgtgggcaggt

SEQ ID NO: 1063 - DNA, 1494 bp, Camptotheca acuminata
atggacttcttttcgttcttgctgtattttttgtttactctgagtttagtacaagctactatttcactggttcgcggttctaagcataaaggacgaaaattgccaccgggtcctgcaccattgcctatagtaggtaacctactaaaactgggagatcaaccacacaagagtctggccgatttggctaaaatccatggtccaataatgaccctcaagcttggacatataaccactgtcataatttcctcttcagatttagctaaagaggtattgcaaaagcaggatcttgctttctcatcccgttctattccagacgccattagagcccataatcaatttcaatattcagttgtctggttgcctgtggcaaatcaatggaggtcgttgagaaagattcttaattctaatatttttagcgggaatcgtttggacgccaaccaacacttaaggtggagaaaggtgcaagaattgatcgcttacgtgcgcaaatcatctcaagttggcgacgctgtcgatattggtcgcgccgcattcagaacgtcattgaatttgttgtctaacacgatcttcagtgtcgatctggcggatcctaataacgactctgctaaagaatttaaagacttagtgtctaacatcatggttgaggctggtaagcctaaccttgtggattacttccctgttctggaaaagatagatcctcaaggcatcagaagaagaatgacaatccactttgggaaagtattagaaatgttcggaagattaatcaatgaaagattagaattccgtcgtctacgttcatccgtcatttctaacgacgtattggatgtcttactgaacactgaagagtctggtaacgagatcgatagaaaccatattgagcgtatgtgtcttgatttgttcgttgctggcactgacacaacaagctcgactttagaatgggctatggcggaagttttgcataaccccgaaacattggtcaaggctaaggctgagttagaacaaattattggtagaggtaaggcgatcgaagagagcgacatatctaacttgccataccttcgttcaattatcaaagaaactttgcgtttgcatccaccagtcccatttctgatacctagaaaagttgaagtggattccgaggtcagcggttatactgtgcctaagggttcccaggtattggtcaacgcttgggctataggtcgagatccctgctgttgggaaaatccattgaatttttccccagaaagatttttgaattcagagttagatgttagagggagagattttgaattgatcccattcggtgctggtcggaggatttgccctggtttaccattggccattagaatggtaccagtcatgctagggtcgttattgaactccttcgattggaagcttgatggtgggattaaaccagaagaactcgacatggaagagaaattcggcattactttgcagaaagctcaacccttacgggctgtccccacgttagta

SEQ ID NO: 1064 - DNA, 1479 bp, Vinca minor
atggattacttaaccatcgccttaggtttgcttttcgctttgactttttaccagggattgacctatctgtccaggcgttcacaaaagcttcctccaggtccgcttccccttcctatcataggcaatttgcatcttcttggggatcacccacacaaatctctagccaagctgtctaaaaaatacggccctataatgtcgttaaaactgggacgtatcacgaccttagtcatttcttcttcgacgacggcaaaggaggtcctacaaaaacaagatttggcattttcttcaaggtccgtaccgaatgcattgcatgctcacaaccaattccaatactcggtagtgtggttgcctgttgctagtagatggcgttcattgcgaaagattttgaactccaacatcttctcgggaaatcggttagatgcgaaccagcatctaagatgccgtaaggtggaggaattaatagcatactgtaggaaaaactgtcaatccggtgaagcggttgatttaggtagggctgctttcagaacatctctcaacctactttcgaatacgatcttttcaaaggaccttaccgatccttactcggattcggcaaaggagttcaaggatctagtttggaacatcatggtcgaagctggtaagcctaaccttgtagacttttttcctgttttggagaaggtcgatccacaaggtattcgtagacgtatgaccgtacactttggtaaagtcatccagctttttaatggtttaattaacgaacgactggataaaagaaaatcaagggggggatacaatgacgtcctggacgtcttattaacaaccacagaagaaaatcctgaagaaattgacagaacccacatcgaaagaatgtgtttggatttatttgtagcgggaacagacactacaagtagcactttggaatgggccatggccgagatgttgcggaaccccgagaaaatgaaaaaaactcaagaagaactggctgaagtcgttggtcgagggaaattgattgaagaaggagatgtgtcaagattgccatatcttagatgtgtcgtgaaggaaactctgagagttcatccaccagtcccgttcttgattcctagaaaggtagttcaagatgtggaagtgtgcggctacaaagtacctaaaggttcacaagttttagtcaacgcgtgggctatagggagagacgaaacgttttggaaagatgctttaggttttaaaccagagagatttctagagagtgaattggatacccgtggaagagatttcgaattaattccttttggtgcaggtagacggatttgtcccggccttcctttggctaaccgaatggtcccagtaatgttaggatccttgttaaattcgtttaattggaagttagaaggcggcatagcgcctaaagatctcgatatggaggagaaatttggtatcacattacaaaaagcccatccccttagggcagtgccatctccttta

SEQ ID NO: 1065 - DNA, 1479 bp, Ophiorrhiza pumila
atggattatcttactatcgcgctgggcctattgttcgccctaacgttaatccaaggctggtcattcttgagcagaaggagcaaaaagctgccaccgggtccgacccctttgccaattattggtaacctacacttgcttggggatcaaccacataagtctctcgcaaagcttgcaaagacccatggcccacttatgtctctaaagcttgggcagataaccacactagcgattagttcttcgggtatggctaaagaggttttgcaaaagcaagatttggcatttagttccagatcgattcctgatgctattcatgcgcacaatcaattccaatattctgttgtttggttacccgtagcaactaggtggagatcgttgcgaaagatactgaattctaatattttttcaggtaatagacttgacgccaaccaacacttaagatgcagaaaagtacaagaattgatagcatactgtagaaagaattgccagacaggtgaagctgtagatatcggtagagctgcgtttcgtactagtttaaatttactctctaatactatattcagcaaagacctcactgacccatacagcgactctgcaaaagagttcaaagacctagtgtggaacataatggttgaggcgggtaaacctaatttagttgatttcttcccagtcttggagaaatttgacccgcaaggcataaggagaaggatgacaatccacttcggtaaggtattggaaatgttcggaggattgattaacgaaaggttagacaatggtaagtctagaggtggtaataacgacgttttggatgttttgcttaacgcgtctgaagagacacctgatgaaatcgatcgaacccatattgaaagactgtgcttagatctgttcgttgcgggtacagatactacgtctaacacgttagaatgggcgatggctgaaatgttgaaaacaccagaaaaaatgaaaaaagccaaggctgaactagcggaagtcattggtaaaggcaaagccatagaagaagcagatgtcagtcgactgccttacctcagatgtattgtgaaagaaaccttaagattgcatccaccagtaccttttttaattccacgtaaggtggagcaggatgtcgaagtttgtgggtacaatgtgccgaagggtacccaagttttagtaaatgcgtgggctattggaagagatgaaaccacttgggaaaatgcacttgaattcaaacctgagagatttcttgaatccgaacttgacattagaggtcgggactttgaactaataccatttggtgctggaagacggatctgtccaggtttgccgttagcagttagaatggtcccagtaatgttaggttcattgctgaacagtttcgattggaaactaggagggtctattgcccctaaggaccttgatatggaagagaaatttggtattacacttcaaaaggctaacccactgttggcagtccctatatcacta

SEQ ID NO: 1066 - DNA, 1479 bp, Rauvolfia serpentina
atggactacttaaccattacacttggcttattgtttgccttaaccttttaccaaggtctgtcatatttgtcaagacgatcaaagaagctaccacctggaccagctcctctcccgataattggtaatctacatatgttgggtgatcagccccataaaagtctagctaaattatcgaagaagcatggccctattatgtcattgaagttgggtcaaatcaccactgttgtggtctcctcctccggaatggcaaaagaagtgctacaaaaacacgatctggctttctcttcgagatccatcccgaacgcgttgcatgctcacaatcaatatcaattcagtgttgtatggcttccagtggcttctagatggcgttctttgcgcaagacacttaatagtaatattttttccggtaatagactcgatgcaaatcagcacttgcgttcaaggaaagtagaagagttgattgcatactgtagaaagaactgccaaactggggaggccgttgacgtgggacgtgcagcttttagaacatctttaaatttattatcaaacttgatcttctccaaggatttaacagacccatactcggattcagcaaaagaatttaaggatctggtatggaatataatggttgaagctggaaaaccaaatctagtggattactttcctgtactcgaaaaagttgatcctcaggggatcagacgtagaatgacggttcatttcggtaaagttctgaaactttttgatggccttgttaatgagagattagagcaaagaagatctagaggtgggaagaatgatgttttggacgttttgctgaccaatagcgaggaaaatccggaagagatagatagaacacatatcgagagaatgtgcttagatctattcgttgctgggacagatactacgtcttcaaccttagaatgggctatggcggaaatgttaaaaaaccctgacaagatgaagaaaactcaagctgaacttgcagaagttataggtcgtggaaaggccatagaagagtctgatctgccaagactgccatacttgcgatgtgttgttaaggaaaccttaagaattcacccacctgtcccttttttgataccaagacgcgtggaacaagacgttgaagtatgtggttataaggttcccaaggggagccaagtgcttgtcaacgcctggaccatcggtagagatgaagctgtatgggaagatgcacttgcatttaaaccagaacgctttctagaaagcgagcttgacatccgaggaagggattttgaattaataccgtttggggcaggtagaaggatatgtccaggtttgccacttgcacttagaacagtccccttgatggtgggctctctactcaattccttcaattggaaattagagggtggcataactccaaaagatttggatatggaagaaaaattcggtatcactcttcaaaaggcacatccattaagagcagttccaatacccttc

SEQ ID NO: 1067 - DNA, 1494 bp, Lonicera japonica
atggatttctttacaatcgcattgtcgttgttattcgcttttacgttatttaaagcaattatctcgctgacaaaatcgggtaaaaataaaaatcttcctcctggcccagcacccttacccatcatcggttctctgcataaattaggcgatcaaccccaccaaagcttggctaaattggctaagatatacggacctattatgagtctaaagttaggccggattaccactgtcgtgatttctagcagtgatgcagctaaagaagttctacaaaaaaaagatttagctttctcgtcgagacatgtcccagacgcattacatgctcacaatcaattcaaattttcagttgtctggttaccagtagcacctcaatggagatccttaaggaaaatcttgaactctaatatttttagcggtaaccggctagacgcaaatcaacaccttcgatgccggaaagtcgaagaactaatcacatactgcagaaaatcttcccattcaggagacgccgttgatataggtagagctgcttttcgtacaagtctaaatctattgtcaaatactattttcagtaaggatttaactgacccataccaagattctgccaaggagtttaaagaactagtaggtaacatcatggtagaagctggtaaacctaatttagttgatttttttccctctctaaaaaaaattgatcctcaagggatccgacatagaatgactattcattttggaaaggtcctggaactctttggaggactaattaatgaaagactagaattaaaatcatctcaaaaaagtgatgaaaaaaatgatgttctagacgtttgcttaagcattagcaaagagaaccctgatgagatcgacagaacacacatagaaaggatgtgtctcgacctgttcgttgccggtacggatactacatcatctacgttggaatgggctatggctgaagtcctaagaaatccagaaaccttggttaaagctaaagcggaattggaagaagttatcggcaagggtaagatcttggccgaagcagatgtatcgaacttgccatatctgaggtgtattgttaaggaaactcttagaatccatccgccagtaccattcctaattcctagaaaggtggaaatggatgtagaagcgtgtggttacactgtgcctaaaaatagtcaggtttttgttaatgtttgggcgataggaagagatcctactttatgggaagatcccctgagttttaaacctgaaagatttatggcatcggaattggacgtaaggggtcgtgacttcgagcttcttcctttcggagctggcaggagaatttgcccaggtctgccattggctatccgtatggttcccgtcatgctgggttctttagttaatagctttaactggaagttggatggtggtattgcccctaaggagttagatatgggtgagaaatttggtatcactttggcaaaagcacaaagtctcagagcagtcccatcaccactggtg

SEQ ID NO: 1068 - DNA, 1473 bp, Erythranthe guttata
atggacttcattacattggctctggtgctaatttttgtattaataattattcacgcaatccaaactatttcgacaagaggcaagaaacttcctccaggtccaacactgttacctctgattggaaatttgcatcttttgggcgaccaaccccataaatcactttgtcgattagccgaaacacatggtcccttgatgcgagtccgcttgggctttattaacacagtcgtcatatcttctgctgaaatggctaaggaagtcttacaaaagcatgatttagccttttcgtcaagatctgtaccgaacgcgttattggcacatgaccaattcaaatactccgcagtttggttacccgtcggccccagatggagatctttacgaaaggcattgaattcaaatatgctttcggttggtagacttgacttcggtcaaaacttgagatgcaggaaggtcgatgaattagtggagtattgtagaagatcaagtatttcgggtgaagccgttgatgttggacgagcggcttttagaaccagccttaatctactgtcgaatactatcttttctaaagatctaactgatcctttctcagattctgcaaaagaattgaaggatcttgtttggaatattatgttggaggccggtaaaccaaacttggtagatttcttccccattctaggtaagttagatccccagggaataagacgtagaatgactgtaaacttcggtaaggttattgatctgttatcaggattgattgatgagagaattgagcggggtaaatcggatcaaaatgccgatgttattgatgtattactggcggcatgtaaagagaatccagaagacattgaccgcacacatattgagaggatatgtttggacttgtttgctgccggtacagacacatcgtcgagtaccgtggaatgggctatggctgaggcactggctaactcagaaatcatgaaaaaggcgaaagcggaattggaagaagttgttggaaagggaaaggttatcgaggaggcagacataagtagactaccgtatttgcaatgcatggtaaaagagacattgaggttacacccgcctgtgccactgctcattcctagaagagtggaagatgacgttgacgtctgcggttacaccgttccaaaaaactcacaagttttagttaacgcttgggcaataggcagagatgcagggatatgggaaaaccccttagagttcaaacctgagagatttgtcgggtcggaggttgacgttaaaggccgggattttgaacttataccatttggaggtggtaggcgaatctgccctggtttacctttagcagttaaaatggtacccgtaatggtcggttctctattaaattctttcgattggaaaatagagtatagtggtatcggagaatttgacatggaagaaaaattcggtattactctacaaaaggcaagaccactattagcagtccccattccattg

SEQ ID NO: 1069 - DNA, 1482 bp, Picrorhiza kurrooa
atggactttctaactattatcctaggcttattgtttgcgattacattaatccatggttatcaactactttcaagtaaaggtaagagacttccgccgggccctacaccattgcctcttattggcagccttcatttgttgggcgatcagccgcatcagtcgctagccaaactggcaaaaaagcatggtgagctaatgtgtcttcgactaggttttattaatactatagtcatttcatcagctgctatggctaaagaagtccttcaaaaacaagatttggccttctcctctagaatgtcccctaatgcagtccatgcacatgaccaattcaaatattctgtggtttggttgccagtggcggcgaggtggagatccttaaggaaagtcctcaacagtaagatttttagcgggaacagaatggatgctaatcagcatttacgtggcaggaagagacaggagcttattgcttactgtagaaaaaggtctcaaacaggtggtgcaggtgatatgggtagggcccctttcagaaatccagtgaatcttgccgttgaacatgattttttcaagaggattgaggacccttactctgattccgccaaggagttcaaggatctggtttggaatataatgttggaagctggaaagcctaatttggttgatttttatccggttttagaaaaagtggatccacaagggatccggaaaagaatgactgtacattttggtaaagttatagaacttttttcaggcttgatcaacgaaagaactgagaaagggaaaacgcaagacgccggaactacggatgttatcgacgttctgttaaagatatctaaagaaaacccggatgaaatcgacaggacacacattgaaaggctgtgtctggatttatttgttgccggtacggatacaacgtcaaatacactagagtgggccatggcagaatcccttaagaatccagaaataatgaaaaaagccaaggctgaattagaacaagttattgggaaaggaaaagtgcttgatgaggctgacatccaacgtttaccttatctcaggtgcatggtcaaggagaccttaagaatccaccccccagtgcctttcctcatcccacggaaggtagaacaagatgttgaagtttgtggatatactgtacctaagaactctcaagtgtttgtaaacgcatgggccataggtcgggatgctgaaacctggccgaaccctctggaatttaaacccgaaagatttatggaatctgaagttgacatgagaggcagagattttgaattgattcctttcggtgcaggtaggagaatttgccctggattaccattagccctgagaatggtgcctgtaatgttgggttccctgttgaattcgttcgattggaagttagaaggtggtgctggtccaaaagaactggatatggaagaaaagtttggtattacactacaaaaagctttgccactaatggccgtgcctgttccgcta

SEQ ID NO: 1070 - DNA, 1482 bp, Olea europaea
atggatttcctaactatagttcttgggcttttgttcgccctgaccctaattcaagccttcagatccattagtactagagggaaaaatttgccaccgggccccacaccattacctattattggaaacttacatcttttgggtgatcaaccacacaaaagcttggcaaaactagcaaaaacttatggaccgataatgtgcttgagattcggatcaatcaatacagtagttattacgtcttcagccatggccaaagaagttcttcaaaaacaggatttagcattttctagtaggcatattccaaatgcaattcacgcccacaaccaattcaagtactctgtggtctggttaccagttgccagtacttggcgtagcctacgtaagatccttaattctaacatgttttcgggtaatagactagacgctaaccaacatttgagagttcgtaaagtacaggaattgataacttattgtaggaagaactctcaggcaggagaagctgttgatatagggagggcggcatttaggacgagtttaaatctactgagcaatactatattttcaaaggatttaacagatcctttttctgattcggctaaagaatttaaagatttagtctggaatgttatggttgaagcaggtaaaccgaaccttgtcgacttcttcccagttctagagaaattagatccacttggtattcgcagacgtatgacaattcactttggtaaaattattgaattatttgggggcctgataaatgaacgcctgaaaagacgtatgtcagacaactcaaagaatagtgatgttctagatgtcttacttgatactagccaagaaaaccctgaagagattgacagggttcacatcgaaagattatgtttggacctgttcgtcgccggaaccgacactacctcaagtacacttgaatgggccatggccgaaacgttaaaaaatcctgctaccatgaaaaaagccaaggctgaattggaggaggtaataggtaaaggtaaggttttagaagaagcagatgtatctaggttaccctatttaagatgtatggtcaaagaagccttgaggatacatccaccagttccattcttgatacctagacgagttgaacaagatgttgaagtttcaggttatacggttccaaaaaattctcaggtcctggtgaacgcatgggcaatcggccgggatccaacactttgggaaaacccattagaattcaagccagaaagattcatggaaagtgagttggatatacgcggtagagacttcgagttaattcctttcggggcaggccgtaggatttgtcctggtttaccattggcaatccgaatggtccctgttatgctaggcagtttagttaactcttttgactggaaactagaaggcgggatttctcctaaagatttagacatggaggaaaaatttgggattaccctccagaaggccaatcctttgcgggccgttccaacaccttta

SEQ ID NO: 1071 - DNA, 1479 bp, Gentiana rigescens
atggattacttgacaattgcattggggttccttttcgctttaaccttatatcaggctttgatatctttcagcagaaaatcaaagaaccttccacctggacccgcccccttgcctttcatcggaaatttgcacctcctaggtgatcagccccataagtcattggcaaagcttgctaagaaacacggtccaattatggggctacaatttggacaggtgactactatagtggttacttctagtggcatggccaaagaagttttacagaaacaggatctggctttctccagtaggtccgttcctaatgcattacatgctcacgatcaatataaatactcagtgatttggttaccagtagcatcgcaatggagatcattacgtaaagttttgaattctaatattttttcaggtaatagattggatgcaaatcagcacctaagatgccgaaaagtacaggaactaatcgcttactgtagaaaaaactgccaaactggtgaagcagttgatttgggaagggctgctttcaggacgtctctcaatttgttgtctaacactatcttttctaaagatttaactgatccatattccgacagtgcaaaagaatttaaagatcttgtttggaatgttatggtagaagccggaaagccaaatcttgtggatttttttccagtccttgacaaggtcgatccccaaggaataagaaaaagaatgacctttcactttggaaaaatattgcaacttttcggaggtttaataaacgagcgattacaacagaacaaagccaagggagctcataaggacgtattggacgtcctgttgaagacgagccaagaaacaccagacgagttgaatagaacacacatagagagaatgtgtttggacttgtttgtggccggtactgatacaactagtagtactctagagtgggccatggcagaaatgttaaagtcgccggacaaaatgaacaaggcaaaggaagaattggcacaggtaataggcaaaggaaaagctgtcgaagaggcagatattgcttcacttccatatcttagatgcgctattaaagagacgttgagaattcatcctcctgttccatttctaattccccgacgtactgaacaagaagttgaagtttgtggttacacagtgccgaaaaatagccaagtatttgtcaacgtctgggctattggaagagatgaaactacctggcctgacgcgttggagtttaaacctgaacgctttttagaatccgaaattgatatgagaggtagggattttgaattactgccatttggggcaggccgtagaatctgtccaggattccctctagctgttaggatggtcccggtaatgttgggtagcttgctaaattcattcgattggaaattagaggggggtatcgccccaaaagatcttgatatggaggaaaaatttggtattacattacaaaaagctcacccattacgagcaattcctacttcatta

SEQ ID NO: 1072 - DNA, 1476 bp, Nepeta cataria
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcatta

SEQ ID NO: 1073 - DNA, 2064 bp, Arabidopsis thaliana
atgacttcagctctctatgctagcgatttatttaaacaattgaagtctatcatgggtacagatagcttaagtgatgatgtagttctagtaatcgcaacaacgagtttggccttagttgctggttttgtcgttctcttgtggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtgg

SEQ ID NO: 1074 - DNA, 2142 bp, Catharanthus roseus
atggattctagttcagaaaagttatcaccatttgaattaatgagcgcaattttgaagggagctaagctagatgggtcgaattcgtccgattcaggtgtggcagtttcaccggcagtaatggccatgttgctagagaataaagagctggtcatgattttgactacttccgtggcagtgttgattggttgcgttgttgtgctcatatggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1075 - DNA, 2142 bp, Catharanthus roseus
atggatagctcctcagagaagttatcaccatttgaactgatgagcgcgattctaaaaggagcaaaattagacggaagtaatagctccgactcaggtgtggctgtaagccccgccgtcatggctatgctattggagaacaaagagttagtgatgatactaaccaccagcgtagctgttcttattggctgcgtagtggttttaatctggagaaggtcaagcggatctggaaagaaagttgtggaaccgccgaagctgatcgtacctaaatccgttgtcgagccggaggagattgacgaaggcaaaaagaaatttacaattttttttggaacacagacagggacagcagaagggtttgccaaagccttggcagaggaagcgaaggctcgttatgaaaaagcagtaataaaggtcatcgatatagatgattacgctgccgacgatgaagaatatgaggagaaattccgtaaagaaacgctggccttctttatattggcgacgtatggagacggggagccaactgataacgctgcaagattctataaatggttcgtcgaaggcaacgataggggagattggctgaaaaatttgcagtacggagtattcggtctaggcaatcgtcagtatgaacacttcaacaagatagctaaagtcgttgacgaaaaggtggcggaacagggtggtaagagaatagtccccttggtccttggagacgatgatcagtgtatcgaagacgactttgcggcatggcgtgagaacgtttggccggagttggataatttacttcgtgacgaggatgatacgaccgtgagcacaacatatacggctgcgataccagagtatagagtggtctttccggacaagtctgatagcttaatctctgaggcgaatggtcacgcaaatggatatgcaaatggaaatacggtttacgacgctcagcatccgtgtcgttccaacgtagcggtacgtaaagagctacacactcctgcttctgacagaagctgtacgcacctagacttcgacatcgcaggtaccggcctatcatatggcactggcgatcacgtcggggtctattgtgacaacttgtccgagaccgtggaagaagcggaaagattactaaacttgccacctgagacatatttttccctgcacgctgataaggaagatggcacacccttggctggatcatcattacctcccccttttcctccatgcaccttgaggacggcactaacccgttatgcggatttactgaacacacctaaaaagtcagcgttattggcattagccgcgtacgcaagtgacccgaacgaggcggatagactgaaatatttggccagcccagcaggtaaagatgagtatgcacaaagtttggtcgcaaaccagagatctttacttgaagttatggctgaattcccgtccgctaaaccccccttaggtgtcttttttgctgccatagcaccaaggctacaaccgagattctactccatatctagttccccacgtatggcaccgtccaggattcacgtgacctgtgcgttagtttatgagaaaaccccgggaggaaggatacacaaaggagtctgcagtacgtggatgaagaatgcaattccgttagaagagtctagagattgctcttgggctcctatattcgtaaggcagtctaactttaaattacccgctgatcccaaagttccagttatcatgatcggtccggggacaggtttggctccattccgtggttttcttcaagagagactggcgcttaaagaagaaggagcagaactaggcacggcagtattctttttcgggtgtagaaacaggaagatggactatatatacgaggacgagctaaatcactttttagaaatcggcgcgttatcagaactactagttgcgtttagccgtgaaggtcccacgaaacagtatgtgcagcacaagatggcggagaaggcttccgatatatggcgtatgatttccgacggagcatatgtctatgtctgtggcgacgctaaggggatggcccgtgatgtccaccgtactctacatacaatagcacaggaacagggttctatggactcaactcaagctgagggatttgtcaagaatttacaaatgactgggcgttacctaagggatgtctgg

SEQ ID NO: 1076 - DNA, 2064 bp, Arabidopsis thaliana
atgacgagcgcgctgtacgcgtcagacctttttaagcagttaaaatccataatgggcacagactctttgtctgatgatgtggtattggtaatagccaccactagcttggcactggtcgccggctttgtagtattactgtggaagaaaactactgcagacagaagtggtgagcttaagcccctgatgattccgaaatcactgatggcaaaagatgaggacgacgacttagatctagggtcaggcaaaactagagtatcaatcttctttgggacacaaacagggaccgctgaagggttcgcgaaggcgttgtctgaggaaataaaggcaaggtacgaaaaggctgcggtaaaagatgattacgcagcagatgatgaccagtatgaggaaaaattgaagaaggaaacccttgcttttttttgtgtagctacttatggagatggcgaaccgactgataatgccgcgaggttttacaagtggtttactgaggagaacgaacgtgatatcaagttacaacagctggcgtatggagtctttgctcttggtaatagacaatatgaacactttaacaaaatcggaattgttttagacgaggaactttgtaagaagggcgccaagagattgatagaggttgggctaggcgatgacgaccagtccatagaagatgattttaatgcatggaaggagagtttatggtctgaacttgacaaactactaaaagatgaggatgataagtcagtcgccaccccttatactgctgtaatacctgagtacagagtcgtaacacatgacccaaggttcactactcagaaatcaatggagtccaatgtggcgaacggtaacactactattgatattcaccatccatgtagagtggatgtcgcggtacaaaaagaattgcatacacacgaatctgatagatcttgtattcacctggagtttgatatatcaagaacagggatcacctatgagacaggagaccacgttggggtgtatgccgagaaccacgtagaaattgtcgaagaagctgggaagttattgggacactcactagatctggtttttagtattcacgcggacaaagaagacggctctccattagaatcagcggtgccaccaccattccctggaccatgtacgttaggcacggggttagccaggtatgctgatttactgaatcctcctagaaaatccgcgctagttgccctggctgcatatgctacggaaccgtcagaagccgagaaactaaaacatttgaccagtccggatggaaaggatgagtacagtcagtggatcgtcgccagccagcgtagcttattggaagtaatggcagcctttccatccgcgaagccgcctttaggtgtatttttcgccgcaatagctcccagacttcagcctcgttactacagcatctccagttctccaagattggcgccctcccgtgtacacgttacgtccgcattggtttacgggccaacaccgacggggaggattcataaaggagtctgctctacgtggatgaaaaatgcagtgccggctgagaagagtcatgaatgctcaggggccccgatcttcatcagagcgtctaatttcaaactaccttcaaatccgtccactcccatcgttatggtagggccagggacaggattagcgccttttagaggattcctacaggaaagaatggcgttaaaggaggacggagaggagttgggctcctctttactattcttcggttgccgtaacaggcagatggacttcatctatgaggacgagttaaataactttgttgaccaaggtgttatctcagagttgataatggcatttagtagggagggagcccagaaagagtatgtacaacataaaatgatggagaaagcagctcaagtttgggatctaattaaggaggaggggtatttgtatgtttgcggcgatgcgaagggcatggcaagggacgttcatagaacgcttcataccatcgttcaagaacaagaaggcgtctcaagtagtgaggcggaggcaatcgtgaagaaactacaaaccgagggacgttatcttcgtgatgtgtgg

SEQ ID NO: 1077 - DNA, 2142 bp, Catharanthus roseus
atggactccagcagtgagaaattgtcccctttcgaactaatgtcagccatcttgaaaggtgcaaagctagatggttctaattcctcggacagcggcgtagctgtctcacctgcagtaatggctatgcttctagaaaataaagaattggtcatgattttaactacatcagttgctgtattaataggatgcgttgtggttctaatatggagaagatcttctggttctggcaaaaaagtcgtcgagccaccgaagctgatcgttcctaaatctgttgttgagcctgaagaaattgatgaaggtaaaaaaaaatttactatcttctttggaactcagacaggtacagccgagggtttcgctaaggcacttgctgaagaagcaaaagcgcgatacgaaaaagcagtaatcaaggttattgatattgatgattacgcagcagatgatgaagagtacgaggaaaaattccgtaaagagactttagcgttctttattctcgctacgtacggtgatggagaaccaacagataatgccgccaggttttataagtggtttgttgaaggtaatgatcgcggtgattggctcaaaaacctacaatatggtgtatttggattgggtaataggcaatacgagcattttaacaaaattgcgaaggtcgttgatgaaaaggttgcagaacaaggtggtaaaaggatcgtacctttggttttaggagatgacgatcagtgcatagaagatgatttcgctgcatggagagaaaacgtatggcctgaattggataatttgttacgagatgaagatgatactaccgttagtaccacttacactgccgctataccagagtaccgagttgtcttccctgataaaagtgattcattaattagtgaagcaaatggtcacgcaaatggctatgccaatggtaatactgtttacgatgcgcaacatccctgtagatctaatgttgctgtgagaaaagaattgcacacgccagcatcggatagatcttgcacacatctcgacttcgatattgcaggaactggtctaagttatggtactggtgaccacgtaggcgtttactgtgataatttatcggagactgttgaagaagctgaaagactccttaatttgccgcccgaaacatactttagcttacatgcagacaaggaggatggtacccctttagctggttcatcattgcctccaccttttcccccatgcacattgcgtactgctctcacacgctacgcagacctcttgaacaccccaaaaaaaagcgctttgttggcattagccgcctatgctagtgacccaaacgaagcagacagacttaaatacttggcttcgcctgcaggtaaagatgaatacgctcagtcactcgtagccaatcaaagatccctattggaagtcatggcggaatttccatcggctaagccgccattaggcgttttttttgcagccattgccccgcgcttacaacccagattttactctatctcgtcgtctccaaggatggctccatcacgtatccatgttacttgtgcattagtgtatgaaaaaactccaggaggccgtattcacaagggtgtttgtagcacttggatgaagaatgccattcctttagaagaatccagagactgttcatgggctccgattttcgtaaggcagagtaatttcaaactccctgctgatcccaaggtaccagtcataatgatcggtcctgggacaggtttggctccttttcgcggctttctacaagaaagactggctcttaaggaagagggagcagaattgggtactgccgtgttcttctttgggtgtcgtaatagaaaaatggactacatttacgaagatgaattaaaccactttttagaaataggagctttgtctgaactattagtcgccttttcacgtgaagggccaaccaagcaatatgttcaacacaagatggcggaaaaagcgtcagacatatggcgaatgattagtgacggtgcctatgtttacgtctgtggagatgctaagggaatggcaagggatgttcatcgtacacttcacactatcgcacaagagcagggatcgatggattctactcaagctgaaggtttcgtaaaaaatttgcaaatgactggaagatatctacgagatgtatgg

SEQ ID NO: 1078 - DNA, 2064 bp, Arabidopsis thaliana
atgacttctgccttgtacgcttccgatctatttaagcaattgaaatcgattatgggtactgactctttgtccgacgatgtcgtactagttattgcaactacttctttggctttggtggctggttttgttgtcttgttgtggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1079 - DNA, 2142 bp, Catharanthus roseus
atggattcctcctcggagaagctatcgcccttcgagctgatgtctgccatccttaagggtgccaagctcgatggaagcaactcttccgactctggcgtagccgtatcccccgctgtgatggccatgctgctagagaacaaggagctggtcatgatcctgactacatcagtggccgtgctcatcgggtgcgtcgtcgttctgatttggcgacgaagctctggatcaggaaagaaggtcgtcgagccgcctaagctgatcgtcccgaaatctgtcgtggaaccggaggagattgatgagggcaagaagaagttcacaatattctttggcacacagaccggaacggccgagggattcgccaaggcgctggcggaagaggctaaggcgcgatacgagaaggctgtgatcaaggtgatagatattgacgattacgctgctgatgacgaggaatacgaggaaaagttccgtaaagagacattggcttttttcatacttgctacctatggtgacggcgagcctaccgataacgccgcccgattttacaagtggtttgtcgagggcaacgaccgaggcgactggttgaagaacctccaatacggcgtgttcggactgggcaaccgacagtacgagcatttcaacaagattgcaaaggtcgttgacgagaaggttgcggagcagggcggcaagaggatcgtgccactggtccttggagacgatgaccagtgtatcgaggacgacttcgccgcttggcgtgagaacgtttggcccgagcttgacaaccttctacgagatgaagatgatacaacagtctcgacgacgtacacagccgctattcctgaatatcgcgttgtgtttccagataagtctgattcccttatcagcgaggcaaacggacacgccaatggctacgctaacggcaacacggtgtacgatgcgcagcatccctgtaggagtaacgttgcagtgcgaaaggagctgcatacacccgcttcagaccgatcttgcacccacttggatttcgacattgccggaaccgggctgtcatacggcaccggagaccacgttggtgtatactgtgacaacctatccgaaacagtggaggaggctgagagactgttaaatctgccccctgagacttacttttcgctgcacgccgacaaggaagacggaactccgctcgccggttcttccctccccccccctttccccccttgcactctacggacggccctgacgcgatacgccgaccttcttaacacccctaaaaagtcagccctactggctttggccgcctatgcatccgatcccaacgaggctgaccgattaaagtacctcgcgtcccccgctggcaaagatgagtacgcacaatccctagttgccaaccagcgaagtttgctagaggtgatggccgaattcccctccgctaaacccccactgggcgttttcttcgcagccatcgcacctcgcttacagcctagattctacagcatctcctcgtcgccgcggatggccccttcgcgaatccacgttacgtgcgctctggtctacgagaagacccccggtggtcgaattcacaagggtgtctgctcgacttggatgaagaacgccattccgttggaggaatctcgagattgcagttgggctcctatcttcgtccgacaatccaacttcaagttacccgctgatcctaaggtgcccgtcattatgatcggtcccggcaccggacttgctccctttcgaggtttcctgcaggagcgccttgccctgaaggaagagggcgccgagctcgggactgccgtcttcttctttggttgtagaaaccgaaagatggactacatctacgaagacgagctcaatcatttcctcgaaattggagcactatcggagcttcttgtcgcattttcaagagagggacctaccaagcagtatgttcagcataagatggcagagaaggcctctgatatctggagaatgatcagtgacggagcctacgtttacgtttgcggagatgccaagggtatggcccgagacgttcatcgaactcttcacaccattgcccaggaacaggggagcatggactctacccaggctgagggattcgttaagaacctccagatgacgggccgctatctgcgcgatgtgtgg

SEQ ID NO: 1080 - DNA, 2136 bp, Nepeta mussinii
atggattctaccacagagaagctgtctccttttgaccttatggccgctattctcaaaggagtcaagctggacaactcgaacggttccgcagagacatcgcagcctgccgtggtggccatgttgatggagaacaaggaccttatgatgatgctgaccactgccgtggctgtcctgcttggatgtgtggtgtatcttgtgtggcgcaagggtgctggatcggctaaaaaggtggtcgagccccccaagctggtgctcccaaaggcactctctgagacagaggaagtggatgatggaaagaagaaggtcacaattttcttcggaactcaaaccggaacggctgagggattcgccaaggccctggcagaggaggccaaagcccggtaccctcaggctaacttcaaggtcgttgacatggacgactacgctgccgaagacgaggagtatgaggaaaagttgactaaggagactatggccttcttctttctagccacgtacggagatggggagcccacagacaacgccgcccgattttacaagtggttcgctgagggcaaggaacggggtgactctttcaagaaccttcactatggtgtgtttgggcttggaaaccggcagtacgagcacttcaacaagattgccattgtcgtcgacaacatcttggccgagcagggtggaaagcgactggtgcccgtgggactcggtgacgacgaccagtgtattgaggatgatttcgctgcctggcgggagaacgtgtggcctgagctggacaacttgctccgaaacgaagatgacgccagtacagtgtccactccttacactgctgcagtcctggagtatagagtggagtttcacgaccagtcggatgagttgtcgctcgaaaactccctcgccaatggccatgctaacggcaacgcctcctacgacgctcagcacccatgccgggccaacgtcgctgtgaagcgagagctgcacacccccttgtctgaccgatcttgcacacacttggagttcgacatttctggaaccgggctccaatacgagaccggggaccatgtcggtgtttactgcgagaacctgatcgaaacggtggaagaggcggagcgactgctaggactctctccccagacttacttctcggttcacacagacaaggaggatggcactcctctgggtggcagtgcgctccccccaccgttccccccctgtacgctacgtacagccctttcccgatacgcggatctgctgaatgctccgaagaagagcgccctgacagcccttgctgcttacgcatcggaccctaccgaggccgaccgtctgaagcacttggcatcgccggccggaaaggaggaatacgcccagtacgttgtggcctctcaaagaacgctgctggaagtaatggccgactttcctagcgccaagccccctcttggtgttttcttcgctggtgttgcaccccgtctgcaacctaggttctatagtatctcctcctcaccaaagatcgcgccctttcgaattcatgtcacctgtgcgttggtatacgataagacccctactggccgaattcacaaggggatttgctccacctggatcaagaacgctgtcccccttgaggaatcatctgattgctcgtctgcccctatcttcgttcgtaattccaacttcaagctcccttcggatgccaacattcctatcatcatgattggcccgggaacaggtcttgcccctttccgaggattcctgcaggaacgtttggcccttaaggagagcggagctgagttgggccctgcaattcttttttttggatgtcgcaatcgaaagatggatttcatctacgaggacgagctgaacgattttgttaaagcgggcgtagttagtgagctgatagtggcttttagtcgagaaggaagtaccaaggagtacgtgcagcataagatggcacaaagagcttctgacgtttggaagatgatttccgacggcggctatatctatgtctgcggggatgctaagggtatggccagagacgtccaccgaacccttcacaccattgcccaagagcagggatctatgtcttcctcggaggccgaaggtatggttaagaaccttcagatgactggacgatacttgagagacgtgtgg

SEQ ID NO: 1081 - DNA, 2076 bp, Camptotheca acuminata
atgagctcggattctgagctgatccgatggttcgaatccatcttcggtgtctcgttgggcagcaactccgtttccgattccgttgctatgtttgtgactacatctgttgccgtgatcatcgggcttctgttcttcctctggcgacgttcgagcgatcgttctaaggagtcaaaccccgtggtggtgccacgtcccttacttgtggaggcagaggaggatgaggtcgaggtgggatccgggaagactaagctgaccattttttatggaacacagacaggcacagcagagggattcgcaaaggcactcgccgaggagatcaaggccagatacgagaaggctgtagtgaaggtggttgacctggacgactacgctgatgacgatgagcagtatgaggaaaagcttaagaaggaaaccctggcgttcttcatggtggctacctacggtgacggtgagcctaccgataacgcagcccggttctataagtggtttactgacggtaaggagagaggcctgtggcttcaacaactcaagttcggcgtgttcggtctgggtaaccgacaatacgagcacttcaataagatcggcaaagtgctggaccaggacctctctgagcagggcggtaagcgtctcatccccgtgggactgggtgatgacgaccagtgcatagaggatgactttgctgcctggcgcgaactactgtggcctgaactggatcagctgctgagggacggcgacgacaccaataccgtttcgaccccttacaccgcagtaatccccgagtatcgggtcgtgatttacgacccgacaactacatcctttgaggacaagcacctcagcatggcaaacggaaacgcgtcttacgacattcatcatccttgccgagtgaacgttgcagtgcagagagagctccataaacctgaatctgacagatcctgcatccacctcgagtttgatatctcttccactggcattacatatgagacaggagatcacgtgggtgtttacgctgataactgtgatgagaccgtggaggaggctgcacggctcctgggtcagccgctcgatctactattctccatccacagcgatgacgacaacggtacccctctcggcggttctttgccccccccttttcccggaccttgcacactgagaactgccctcgccagatacgccgacctccttaaccccccccgtaaggccgcccttatcgccctggccgcacatgcgatcgaaccctccgaatccgagaagctgaagtttctgtcctctcctcagggaaaggacgactactcgcagtgggtcgtgggaagccagagaagccttctggaggtaatggcagagtttccaagcgccaagcctcccctgggagtcttcttcgccgccgtcgccacccggctccagccccgttattactctatttctagtagcccgagatttgcccccagccgagtgcacgttacatgtagcctcgtatacggacctacttcgacaggccgaatccacaagggtgtgtgtagcacctggatgaagaacgccgtgcctctcgagaagtctcgaaactgctcttgggcccccatatttattcgagccagcaatttcaagctgcccagtaacccctcaattcccatcgtgatggtcggccccggcacagggcttgcaccattccgaggatttctccaggagcgactcgctcttaaggaggatggaatccagctgggacccgcacttctgttttttggctgcaggaaccggagaatggatttcatctacgaggacgagctcaacaacttcgtagaccgaggtgtcctctctgatcttattgtggccttttcccgagaagggcctcaaaaggaatacgttcagcacaagatgatggaaaaggccgcatacatttggaacctcatttcccaggagggctatctatacgtctgcggcgacgcgaaaggcatggctagggatgtgcaccgaacgctgcacacaatcgttcaggagcaggagaatgctgatacctccaaggctgagtcggtagttaagaagctgcaaatggacggccgatacctgcgagacgtgtgg

SEQ ID NO: 1082 - DNA, 2136 bp, Arabidopsis thaliana
atgagcagcagttcgtcttcctctacatccatgatcgatctgatggccgctattatcaagggcgaaccggttatagtgtcggaccccgcgaatgctagcgcttatgagtctgtcgcggctgagctcagctctatgttaatcgagaaccgacaattcgccatgattgtcacaacatctattgccgtccttatcggctgtattgtcatgcttgtatggcgacgaagcggatcaggcaacagcaagcgtgtggagcctctgaagccactagttatcaagccccgcgaggaggagattgatgatggcagaaaaaaggtcactatctttttcggcacgcagaccggaacggccgagggattcgctaaggccctcggtgaggaggcgaaggcccgatacgaaaagacccgtttcaagatcgtggatcttgacgactacgccgcagacgatgacgagtacgaagaaaagctcaagaaagaggacgtggccttcttcttcctcgcaacctacggcgatggtgagccgactgataacgcagcccgattttacaagtggttcaccgagggcaacgatcgcggcgagtggcttaagaacctgaaatacggtgtcttcggactcggaaaccggcagtacgaacactttaataaagttgccaaggtcgtcgacgacatcctcgtggagcagggtgcacagcggctggttcaggtgggcctgggagatgatgatcagtgcatcgaggacgactttaccgcgtggcgagaggctctgtggccggagctggacaccattctgcgggaggagggtgacactgccgtggctacgccctacaccgccgctgtccttgaataccgggtgagcattcatgacagcgaagacgccaagtttaatgacatcactctcgccaacggtaacggctacacagtgtttgacgcccagcatccctataaagctaacgtcgctgtaaagcgggaactgcacactccagagtccgatcgttcttgtattcacctggagttcgatatcgcgggaagcggcctgactatgaagctaggagaccatgtcggggttctttgtgataacctctctgagaccgtcgacgaagccctacgactacttgacatgtctccagatacttacttctcgttgcacgcggagaaggaagacggaactcccatttcctcctccctgcctccccctttccctccgtgcaaccttcgcaccgctctcaccagatatgcctgtttgttgagttctccaaagaagtccgccctggtagctctagcagcccacgcctcggaccccactgaggccgagcgcctgaagcacttggcgtcccctgctggtaaggacgagtactctaagtgggtggtcgagtcccagcggtctctcctcgaggtgatggctgagttcccttcggccaaaccccccctcggagtgttcttcgccggtgtggcaccccgattgcagccgagattttactccatctcctcttcgcccaagattgcagaaacccgtatccatgtcacctgtgcgttggtgtacgagaagatgcctaccggtcgtatccataaaggggtgtgctctacctggatgaagaatgctgtcccttacgagaagtccgagaagctcttcctgggtcgccccattttcgtgcgacagtctaactttaagctgccctccgattccaaggttcccatcattatgattggacccggcactggtctggcaccttttcgaggcttcctgcaggaaagacttgccctggttgagtccggtgtcgagctcggaccctcggtgctgtttttcggttgtcggaatcgaagaatggactttatctacgaggaagaattgcagcgttttgtcgagtccggagctctggccgagctatccgtcgcgttctcccgagagggccccaccaaggaatacgtccagcacaagatgatggacaaggcgtccgatatttggaacatgatttcgcagggagcttacctatacgtttgtggggacgccaagggaatggcgcgagacgtccaccggtccctgcacaccattgctcaggaacagggatctatggactctactaaagccgaaggcttcgtgaagaatctgcaaacgtctggtcgatatctgagagacgtctgg

SEQ ID NO: 1083 - DNA, 2064 bp, Arabidopsis thaliana
atgacgtctgccctttatgcctccgacctgtttaagcagttgaagtcgatcatgggaacggactctctatctgacgacgtcgtgctggtcattgccaccacctctctcgccctggtggccggctttgtggttctcttatggaagaagaccacagcagaccgatctggagaactcaagcctctgatgatccctaagagcctgatggcaaaggatgaggacgatgacctggatcttggatctggaaagacgcgggtttctatcttttttggtacccaaaccggcaccgcggaagggttcgctaaggctctctctgaagagataaaggctagatacgagaaggccgccgtcaaggatgactacgccgctgacgacgaccagtacgaggaaaagctgaagaaggagacactggctttcttttgtgtcgccacctacggtgatggcgagcctactgataacgccgctcgattttacaaatggttcacagaggaaaacgaaagagacattaagctgcagcaactcgcttacggagtctttgctctgggcaatcgacagtacgagcacttcaataagattggaattgtccttgacgaagagctgtgcaagaagggagctaagcggctgattgaggtgggtctcggtgacgatgatcaatctatagaagacgattttaatgcctggaaggagtctctctggtcggaacttgacaaactgctcaaggacgaggacgataagagtgtcgccactccctacaccgctgtgattcccgaataccgtgtggtgacccacgacccccggtttaccacccagaagtccatggagtcgaacgttgctaacggtaacaccaccatcgatatccatcacccctgtcgagttgacgtggccgttcagaaggagctccacacccacgagagcgacagatcttgcatccatctcgaattcgatatttcacgaacggggatcacctatgagaccggagaccacgtaggcgtctatgctgaaaaccatgtggagattgtcgaagaggccggcaagctgctgggacactcactggacctggtgttctctatccacgctgacaaggaggacggctcacctctggagtccgcagtgcccccccccttccccggcccctgtacattgggtactggtttggctcgatacgcggaccttcttaaccccccacgaaagtccgcacttgtcgccctggccgcatacgctactgaacccagcgaggccgaaaagctgaagcacctaacttctccagacgggaaggatgagtactcacagtggatcgtggcctcccagcgctcactgctcgaagtgatggccgcatttccctctgccaagcctccactgggcgtgtttttcgctgccattgcccctaggctccagccccgttactacagtattagctcaagcccccgactggcgccctcgagggtacacgtgacttctgctctggtctacggtcctactcctaccggacgaattcacaagggtgtgtgtagtacatggatgaagaacgccgtcccagctgagaagtcccatgagtgttcgggcgctcccatttttattcgcgcctcaaacttcaagctgccttcaaacccgtcgaccccaattgtgatggtgggacctgggactggattggccccttttcgaggcttcctccaggagcgtatggcactgaaggaggacggggaggaactcggctcgtctttgcttttttttggttgtagaaacagacaaatggatttcatttacgaggacgagctgaacaactttgtcgatcagggtgtcatctcggaactgatcatggcgttctcgcgtgagggtgcgcagaaggaatacgtgcagcacaagatgatggagaaggcggcgcaggtttgggatctgatcaaggaggagggatacctctacgtatgtggcgacgctaaaggaatggcacgagatgtccatagaacactgcacacaatcgttcaggagcaggagggtgtctcctcgagcgaggctgaggcgatcgttaagaagctgcagaccgaaggcagatacctccgggatgtctgg

SEQ ID NO: 1084 - DNA, 2136 bp, Nepeta mussinii
atggattcaacgactgaaaaactttcaccgtttgatttgatggcggcaatcttaaagggcgttaagctggataattctaacggaagtgcagagacctcccagccggctgttgtcgcaatgctgatggagaacaaggatctgatgatgatgttaaccacggccgttgctgtcctgcttggttgcgtggtttacttggtgtggagaaagggggcaggcagcgccaagaaagtggttgagccaccaaaactagttctgccaaaggcgctgagtgagactgaggaagtcgacgacgggaagaagaaagtaacgatttttttcggcacacagaccggtacagctgaggggttcgccaaggctctggctgaagaagcaaaagctagataccctcaggccaatttcaaggttgtagatatggatgattatgcagctgaagatgaagaatatgaagagaaactgacgaaggagacgatggccttttttttcctggcgacatatggtgacggagagcctacagataacgccgcccgtttttataagtggtttgcggagggcaaagagagaggtgattcttttaagaatttgcactacggcgtgtttggtctaggcaaccgtcaatatgaacattttaacaagattgccattgtggtagataatattctagcggagcaaggagggaagagactggtgccggttggattgggcgatgatgatcagtgtattgaagatgattttgctgcatggagagaaaatgtctggcccgagttagacaatttgcttaggaacgaagatgatgcctccactgttagtaccccttataccgcggctgtgctagaatatagggtggaattccacgatcagtccgatgaactaagcttagaaaactcattggcgaacggacacgcaaacggaaacgcgtcatacgacgcccaacatccttgcagagccaacgtagctgtaaaaagagagcttcataccccgctgagcgaccgtagctgcacccacttagaattcgatatttctgggaccggcttgcaatacgagactggtgaccacgtaggagtctactgcgagaatctgatcgaaactgtcgaggaagccgagcgtctgcttgggttatctcctcaaacatacttctctgttcatacggacaaagaagatggaacacctctaggtgggtccgcacttccgcctccattccctccatgcacactacgtacagccctgtcaagatacgcagacctgctaaacgctccaaaaaaatccgctcttactgccctggcggcgtacgcaagcgacccaaccgaggccgataggttaaaacacttagcttctccggcgggtaaggaggaatacgctcagtatgtggtggcttctcagcgtacactgttagaggtcatggctgatttcccgtctgcgaagcctcccttgggtgtctttttcgcgggagtggcaccgaggttacagccccgtttctattccattagtagttctcctaagatcgccccgttcagaatccacgttacatgcgcgctggtatacgataaaactccgacggggaggatccacaagggtatttgctccacctggatcaaaaacgccgtaccgttggaggagtcctcagattgcagtagtgctccaatctttgttaggaactctaattttaaattaccatccgacgctaatatacccattatcatgatcggtcctggtacagggttagccccattccgtgggttcttgcaagaaaggttagcgctgaaagaatcaggggcggaactgggaccagcgatactttttttcggttgccgtaatagaaagatggactttatatatgaagacgagttgaacgattttgttaaggcgggcgtggtatctgaactgattgtcgcatttagccgtgagggttccacaaaagaatatgttcaacataagatggcacagagagcttcagacgtttggaaaatgataagcgatggtgggtacatctacgtatgcggcgacgccaagggcatggcgagagacgtacacagaacgttacacaccatcgcgcaagagcaaggttccatgagtagttctgaagctgaaggaatggtaaagaaccttcagatgaccgggcgttacctgagggacgtttgg

SEQ ID NO: 1085 - DNA, 2076 bp, Camptotheca acuminata
atgtcttcagattcagaattgataagatggttcgagtctatatttggagtaagcctgggtagcaatagcgtgtcagattctgttgcgatgttcgtaaccacctctgtcgcagtaataatagggctgctattttttttgtggagaaggtcttccgatagatccaaagaatctaatccggttgttgtgcccaggcccctgctggtagaagcggaggaggatgaagttgaagtaggctccggaaaaacgaagcttacgatattttatggtacgcaaacgggcacagcagaaggtttcgccaaggctttagcggaagaaataaaggccaggtatgagaaagcggtagtgaaagttgttgacctggatgactatgccgacgacgatgagcaatatgaggagaaactgaaaaaagaaacactagcattcttcatggtggctacgtatggggacggtgaaccaactgacaatgcagcgagattctataaatggttcacagacggcaaagagaggggcttatggctacaacaacttaaattcggagtgttcggattggggaaccgtcagtacgagcactttaacaagattggaaaggttttagatcaggacttgtccgagcagggaggcaagaggttaattccagtggggctaggcgacgacgatcagtgcatagaggatgattttgctgcatggagagagctgttatggcctgagctggatcaacttttgagagatggcgacgatacgaacaccgtatctacaccgtacacggcggttattcccgaatatagagtagttatatatgacccaaccacgacgagtttcgaggacaaacacttaagtatggccaacggcaatgcttcatacgacatccatcatccgtgccgtgtcaacgtagcggttcaaagagagttgcacaagcctgagtctgacaggtcatgcatacatctggagttcgatatttcatcaactggtattacatatgagacgggagaccacgtaggtgtttatgcggacaactgcgacgagacggtggaagaagccgcaaggctgctgggtcaaccgctggatttgctattctcaatccatagcgacgatgacaacgggactccactgggtgggtccttgccccctccattcccggggccctgcactttaaggacagcgttagctcgttatgccgacctgctaaacccaccccgtaaagccgcattaatcgcgttagcggcccatgcgatcgagccgtcagaaagcgagaaactaaaattcctatcttcaccccaaggaaaggacgactattcccagtgggttgttggatctcaaagatcattgttggaagtgatggccgaattccccagcgcgaaaccccccttaggagtgttttttgctgcagttgcaaccaggcttcaaccaagatactacagcattagctcctcacccagattcgcgccaagcagagtgcatgtcacatgcagcctggtctacgggcctacgtctacggggaggattcataaaggcgtttgtagcacgtggatgaagaacgccgtacccttggagaaatcaagaaactgtagttgggctcctatcttcatccgtgcatccaacttcaagcttccgtctaacccctcaatacccatagttatggtaggtcctggaactggtctagcacccttcagggggttccttcaggaacgtcttgccttaaaggaagacggcattcagttgggcccggcactactgtttttcggctgcaggaaccgtaggatggatttcatctatgaggacgaattgaataactttgtggaccgtggcgtcctttctgacttgatcgtagcattttcccgtgagggtccgcagaaagagtatgttcaacataagatgatggaaaaggccgcctacatatggaatttgatttcacaggagggttatttatacgtatgcggggatgccaaaggtatggcaagagacgtacataggacattacataccattgttcaggagcaggaaaacgccgacaccagcaaggcggaaagcgtcgtaaaaaagttgcaaatggatggtagatatctaagggacgtatgg

SEQ ID NO: 1086 - DNA, 2136 bp, Nepeta mussinii
atggactcgacaacagaaaaactgagcccattcgacctaatggccgccatactaaaaggcgttaagttagataattctaatggttcggcagaaacgtcgcagccagctgttgtggctatgttgatggaaaataaagacctaatgatgatgttgacaacagcagtggctgtgttattaggctgcgttgtttatctggtgtggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1087 - DNA, 2076 bp, Camptotheca acuminata
atgtcatcagactcagaattaatccgatggttcgaatctatttttggagtctcattaggatccaactcagtcagcgacagtgtcgctatgttcgttactaccagcgtcgcagttattataggattattgttctttctttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1088 - DNA, 1485 bp, Swertia mussotii
atggatttcgatttcctaaccatcgcaattggttttctctttacgattaccctctaccaagccctcaacttcttctctaggaagtctaagaacctgccccctggtcctagtcccctgcccctgattggaaatcttcaccttctcggtgaccagccccataaatccctggctaagttggccaagaagcacggcccaatcatgggacttcagcttgggcaggtgactaccatcgtcgttacatctagcggcatggcgaaggaagtccttcagaagcaggacttggctttctcgtcgcgaagcattcccaacgccatccatgcccatgaccagtacaagtactctgttatctggctcccagttgcctcacgttggcggggtctccgaaaggccctcaattccaacatgttctccggtaacaggctggacgccaaccagcacctgagatctcggaaagtgcaggaactcattgcttactgccgcaagagctctcagaccggggacgcaattgacgtgggacgagccgcttttcgaacttctctcaaccttctttctaacaccatgttctccaaggacctgacagacccctactcggattcggcaaaggagttcaaggatctggtctggaacgtgatggtggaggcagggaaacccaacctggtggattacttcccccttctcgacaaggtggacccacaggggatcaggaagcgaatgactattcatttcggtaaaatcttggaactttttgggggtcttattgacgagcgacttcagcagaaaaaagccaagggtgtgaacgatgatgttctcgacgtccttctcaccacgtccgaggaatcgcccgaagaaattgatcgtacccatatccaacgaatgtgtcttgaccttttcgtggccggtactgacaccacctccagtaccctggagtgggccatgagcgagatgctgaagaaccccgaaaagatgaaggctgcgcaggccgagctggcgcaggtgatcggcaagggtaaagccgtggaggaagccgaccttgcgaggcttccctacctccggtgcgctatcaaggaaaccctcaggattcatccacctgttcctcttctcattccgcgcaggactgagcaggaggtggaggtctgtggctatacggttcctaagaactcccaggtcctcgtcaacgtctgggcgatcagtcgcgacgacgccatctggaaagaccctctgtccttcaagccggagagatttcttgagtctgagctggagatgcgaggtaaggacttcgagctgattccatttggcgccggccgacgcatctgtcccggcttgcccctcgcggtgcgaatggtgcctgttatgctcggctctctgctcaatagcttcgattggaagctggaaggaggcattgcccccaaagacctggacatggaggagaagtttgggattaccttgcagaaggctcaccctcttcgagctgtagctacccccctc

SEQ ID NO: 1089 - DNA, 1494 bp, Camptotheca acuminata
atggactttttttcctttcttttgtacttcctctttacactttccctggttcaggcgacgatttctctcgtccgaggatccaagcataagggacgaaagttgccccctggtcccgctccgcttcccattgtgggaaacctgttgaagctgggtgaccagccccacaaatctctcgcagatcttgccaagatccacgggccgatcatgactctgaagctgggacacatcactaccgtgatcattagctcctctgacctcgctaaggaggtgctgcagaagcaggacttggccttcagctctagatcgatcccagacgcaatccgggcccacaaccagttccagtactcggttgtttggctgcctgtcgcaaaccagtggagatcccttcggaagattctcaacagcaacattttctcgggcaatcgtctcgacgcgaaccagcatctccggtggcggaaggtgcaggagcttattgcttacgtgcgaaagtccagtcaggttggggacgcagtagatatcgggcgagcagccttcagaacgtccctgaacctcctctctaataccattttttctgttgacctagccgaccctaacaacgactccgcgaaggagttcaaggatctcgtttctaacatcatggtggaggccggaaagcctaatttggttgattacttccccgttctggaaaagatcgacccccagggtatccgccgaagaatgaccattcacttcggaaaggttctggagatgttcggacgactgattaacgagcgactggagtttcgacgactgcgctcatctgtcattagcaacgacgttctcgacgtgcttctcaacacagaggagtccggaaacgagatcgaccgaaaccacatcgagagaatgtgcctcgaccttttcgtagcaggtaccgataccacctccagcactcttgagtgggccatggccgaggtgctccataacccagagactctggtcaaagctaaggctgagctcgaacagattattggtcgaggaaaggccattgaggagtcggacatctccaacttgccctacctgcgatctatcatcaaagagacccttcgtttgcatccccctgtgcccttcctaatcccgcggaaagtggaggtggacagcgaagtgtccggttacacggttcctaagggttcgcaggtcctggtcaacgcctgggccataggacgcgacccatgctgctgggagaaccctcttaacttctcgccagagcggttcctgaactctgagctggacgttcgtggccgagactttgagctcattccttttggtgccggacgacgtatttgccccggtctccccctggctattcgaatggtaccagtcatgctgggcagtctcctgaatagctttgactggaagctggacggcggtatcaagcctgaggagctcgacatggaggaaaagttcggaatcacactgcagaaggcacaacccctgagggccgtcccgactctggtg

SEQ ID NO: 1090 - DNA, 1494 bp, Lonicera japonica
atggatttttttacaatcgccctctccctcctcttcgctttcacgctattcaaggccattattagcctcaccaagtctggtaaaaacaagaacctccctcctggaccagcgccgcttcccattatcggttccttgcacaaactgggagaccagcctcaccagtcgcttgctaaacttgcaaaaatttacggtcccatcatgtccctgaaactgggtcggatcaccacagtggtgatctcatcctctgacgctgccaaggaggtgctacagaagaaggacctggccttttcatcaagacacgtacccgacgccctccatgctcataatcagttcaagttctcagtggtctggttgcctgtggcaccccagtggcgaagcttgagaaagatcctcaattccaatattttctccggcaatcgacttgatgcgaatcagcacctccggtgccgaaaggtcgaagagcttattacctactgtaggaaatcatctcactcgggcgacgctgtggacatcggtagagccgctttccgcacatctctgaatctcctctctaataccatcttctcgaaggacctgaccgacccctaccaggatagcgcgaaggagtttaaggagctcgttggtaacattatggtcgaggctggcaagcccaatctcgtcgacttctttccttccctgaaaaagattgatcctcaaggcattagacacagaatgaccattcattttggcaaagtgcttgagctctttggtggattgatcaacgaacgacttgagctcaagtccagtcagaagtctgatgaaaaaaatgacgtcctcgatgtgtgtctgagcatttctaaggaaaatcccgatgagatcgatcgaacgcacatcgaacggatgtgtctggatctttttgtcgcgggcacagatactacttcgtctaccctggagtgggcgatggccgaagtcttgcggaacccggagaccctggtgaaggccaaggccgagcttgaggaggtgatcggtaaaggcaagatcctcgcagaagccgacgtgtcgaacctgccctatctgcgttgcatcgtgaaagaaaccctgagaatccacccaccagtcccgttcctgattccccgcaaagtcgagatggatgttgaggcttgcgggtacaccgtgcccaagaactcgcaggtgttcgtgaacgtctgggccattggccgcgacccaaccctgtgggaggaccccttgtctttcaagcctgagcgattcatggcctcagagctggatgttcgaggccgagacttcgagctcttgccttttggcgcgggccgacgaatctgtcccggcttgccactggccatcaggatggttcccgtgatgctgggtagcctcgttaactcttttaactggaagctcgacggaggaatcgcccctaaggagttggatatgggcgagaagttcggtattactctagctaaggcccagtccctcagagcagtcccttctcccctagtg

SEQ ID NO: 1091 - DNA, 1473 bp, Erythranthe guttata
atggatttcattaccctcgcactggtgctaatctttgtgttgatcattattcatgcgatccagactatttccacccgaggcaaaaagctgccgcccggaccaacccttcttcccttgattgggaacctccacttgcttggtgaccagccgcataagtctctttgtcggctggccgagactcatggaccactgatgcgagttagactgggcttcatcaacaccgtcgtcatctcctcggctgagatggcgaaggaagttctccagaagcatgatctggcgttctcatcccgttcggtcccaaatgctctcctcgcccacgaccaattcaagtatagcgctgtttggcttcctgtgggtcccagatggcgatcgctgaggaaggcgctgaactcgaacatgctttctgttggtcggcttgactttggccagaatctcagatgtcgaaaggtcgatgagctcgtagagtactgccgacgctcttctatcagcggagaagctgtggatgtgggtcgggccgcctttagaacatctctcaacctgctgtccaacactattttctccaaggatctgacagatcccttctctgacagtgcgaaggagctgaaggatctcgtgtggaatatcatgctcgaggctggaaagcccaacctcgtggacttcttccctattttgggtaaactggacccgcagggcatacggcggcgaatgacagtcaattttggaaaggtaatcgatttgctctcgggtctgattgacgaacgaatcgaacgaggcaaatccgaccagaacgccgatgtgatcgatgttttactcgctgcctgtaaggagaatcctgaggatatagatagaactcacatcgagcgtatttgtctagacttgtttgctgccggaactgacacttcttcttctacagttgagtgggctatggccgaggcgctcgccaattctgaaattatgaaaaaggccaaggcggagttggaggaggtcgtgggaaagggtaaggtcattgaggaagccgacatttctcgactgccctacctgcagtgcatggtcaaggagaccctccggctccaccctcccgtgcctcttctgatcccccgtcgagtcgaggacgacgtcgacgtgtgcggatacaccgtaccaaagaattcgcaagtgctcgtcaacgcctgggccatcggccgcgacgcaggtatttgggagaaccctcttgagttcaaacctgagcgattcgtaggcagtgaggtcgacgtgaagggtcgagatttcgaactcatcccctttggaggcggccgacgaatctgcccgggactgcctctcgccgtgaagatggtacctgtcatggtgggttctcttctcaactctttcgattggaaaatcgagtactccggaattggggagttcgacatggaagaaaagtttggaattaccttacagaaggctcgacccctgttggcagtccctatccccctt

SEQ ID NO: 1092 - DNA, 1458 bp, Erythranthe guttata
atggatttcatcacactcttttctctgggtttggtgtttattctgattttgatgactgctgtgcaaacgatctctactcgtgggaagaagctgcctcccggcccgacccccttgcccctgattggaaaccttcacctcctcggagatcagccgcataagtcgctgtgcagactggccaaaactcacggtcccctgatgtacctgcgactcggcttcattaacacagtggtcatttcgtcagccgagatggctaaggaggtgcttcagaagcacgaccttgccttttctagtcgcagtattcccaatgccatccacgctcacgatcagtttaagtacagcgtggtttggctccctgtcggacccagatggagatcgctacgcaaggccctgaccgccaatatgttttcttccagccgactggattctggacaaaagttgcgatgtcgcaaggtgcaggagcttgtggactactgccgttcaggagaggtggtggacgttggtcgagcggcttttcgaacctctctcaatctcctgtcctccacgattttttgcaaggatctcaccgaccccttctcggactcggcaaaggagttccgcgacttggtctggaacatcatggtggaagccggaaagcctaatctggttgacttctttccaatcctgggaaagctggaccctcagggcgttcgacgccgcactactgtacacttcggcgagctgctttacctttttggtggtctgatcgacgagcgacttgagaaagggaagtccgaccagaacgctgacgtcatggacgttctgcttgccgcctggaaggaaaacccagaagagatcgaccgaacccacatcgagcgaatgtgcctggacctgtttatagccggaactgacacatcttcttctacagtcgagtgggcgatggcagaggcgctggcgaaccctgagattatgaaaaaggccaaagccgagttggaagagattgttggtaaaggcaaagtgctggaggaggccgatatctccaggctcccctacctaagatgtatggttaaagaaactctgagacttcacccccccgtgcccttccttatcccccgtcgagtcgaggacgacgttgacgtctgtggatacaccgtgcctaagaattcccaggtgcttgtgaacgcctgggccattggaagagacgctggaatttgggagaaccccctggagttcaaacccgagcgatttgtggggtccgaagtcgatgtcaagggaagagactttgagcttattcccttcggtggcggtcggagaatctgtcccggcctacctctggctgtccggatggtgccgatgatggttggaagtctgctcaattcgttcgattggaaggtcgaggaagaaatcatcgacatggaggaaaagttcggtatcacactccagaaggcgcggccactgctcgccattcccattcccttgttc

SEQ ID NO: 1093 - DNA, 1476 bp, Nepeta cataria
atggacttcctcaccatctttatcggccctctgctggctattatcgccctgttctatgcccgactgactatttcgacccgcggtaagaaccttccccctggtccgacccccctgcctttcattggaaacctccatctcttagggcatcatccccacaagtcgctggcccgcctggccaagacctacggtcccctgatgctgctacgtttgggctctgagaacaccgttgtggtatctagtgccgccgtcgctaaggaagtgctgcagaagcatgatcttgccttctcttcccggtcgatccccgatgccgtgcacgctcacgatcagttcaaatactcggtagtgtggctgcccgtggccagccgttggcgctcactgcgaaaaaccatgaactctaatattttctcaggctcctgcttggacgctaaccagcaccttcgttctcggaaggtggaggagctgatcgcctactgtaaggagagctgcagacgtgctgaggccgtcgacgtcggccgagccgcgtttcgtactgcccttaactctttgtcgaatacaatcttctctcgagacctggccgacccactaagcgattctggtaaggagttcaaggatgtcgtgtcttcgattatgatggaggccggtaagcctaactctgtcgattattacccattcctttccagattcgaccctcagggtatccgacgacgcactgccatctacttcgacaagcttatcaacatttttaagggactcattgatgaacgactcgagaaaagacgctcccagtacgaggaggccactgacgtgatcgatatccttctgaacacaattgagcaaaaccctgaggagattgaccgcacacatattgagcgaatgtttctggacttgtttctggcgggcaccgatactacgagcagcacagttgaatgggccatggctgaggccatgaagaaccctgagactatgaagaaggctaaagccgagctggcccaggtcatcgggaagggcaagattgtgcaagagactgacattccccatttgccttaccttcaatgcatcgtaaaggaaacactgagactgcatccccctgtgcccttcctcatcccccgtcgggtccatgaagacgtggatatcctgggatacgttgtgcccaacaacagtcaggtgttcgttaatatgtgggctataggccgagaccctgacatgtggaagaaccctctgcagttcgaccccgaccggtttcatgattctgaggtgggtctacggggtaaggactttgagctcatccccttcggtgccggtcgtcgtatttgccccgggctccctctcgctatgcggatggtccccgttgtacttggatcgttgctaaacagcttcgactggaaggtggaaggcggaaaagagctggagatgaatgagaagtttggtatcacactggagaaggctcagcccctgatggctgtgccaattgctctt

SEQ ID NO: 1094 - DNA, 1482 bp, Picrorhiza kurrooa
atggatttcttgacgattattcttggactgttgttcgccatcaccctaatccacggctaccaactcctctcctctaagggcaagcgactccctcccggacccacccccctgcccctgatcggctctcttcatctgctaggagatcagcctcatcagtccctcgccaagcttgcaaaaaagcatggcgaactgatgtgtctccggttgggctttatcaacaccatcgttatctcctctgctgccatggccaaagaggttctgcaaaagcaggaccttgctttctctagccgaatgtcgcctaacgcagtgcatgctcacgatcaatttaagtactcggtggtgtggctgccggtcgcggcgcgctggcgttctctccgtaaagtgctgaactctaagatcttcagtgggaaccgaatggacgccaaccagcacctccgtggccgaaagcgacaggagcttattgcatactgtaggaagcgtagtcagaccggaggcgccggagacatgggacgagcccccttccgtaaccctgtcaatctcgcggtcgagcatgacttcttcaaacggattgaagacccatactctgattctgcaaaagagttcaaggatctggtgtggaacatcatgctggaagcaggtaaaccgaacctggtggacttctatcctgttctggagaaagttgacccgcaaggaatcaggaagcgaatgactgttcattttggaaaggtgatcgagctgttctctggactaatcaacgagcggaccgagaagggaaagacacaggacgccgggacgacagacgttatcgacgttctactcaagatctcgaaggaaaatcccgacgagattgaccgaacacacattgagaggctttgcctggacctcttcgtcgctggaactgacacgacatctaacactttagagtgggctatggctgagtctctcaagaaccctgagattatgaagaaggctaaggccgagctggagcaggtgattggaaagggaaaggtgctggatgaagccgatattcagcgactgccctacttgcgatgcatggttaaggaaaccctgcgtattcatccacctgtgcccttcctcattccgcgtaaggttgagcaggacgttgaagtctgcggctacactgtgcccaagaacagccaggtcttcgttaacgcatgggccattggccgtgacgccgaaacatggccgaaccctcttgagtttaaaccggagcgattcatggagtccgaggtcgacatgcgaggacgtgatttcgagctaatcccattcggagccggccgacgcatttgcccaggactgccactggctctgcgtatggttcccgtgatgctgggcagcctgctaaactcttttgactggaaactcgagggcggtgccggaccgaaggagctggatatggaggaaaagtttggtatcactctccagaaggctttgcctctcatggccgtcccggtcccgctc

SEQ ID NO: 1095 - DNA, 1467 bp, Picrorhiza kurrooa
atggacttcctaaccatcattctcggactgctcttcgcggttacgcttatccacggctaccagctgctttcctccaagggtaagcgactgccgcccggcccaactccacttcctcttattggttcacttcatctgttgggcgaccaaccacatcagtcgctcgcgaaattggctaaaaagcatggtgagctcatgtgtcttcgcctcggctttatcaataccatcgtgatcagctctgccgccatggctaaggaggttctacaaaaacaggaccttgcattctcgtcgcgaatgagtccaaacgctgtccacgcccacgatcaattcaagtactccgttgtgtggctgccagtcgcggctcgctggcgaagcctgagaaaggtcctgaactccaatatcttctcaggtaacagacttgatgccaaccagcacctccggtgtcgaaaagtccaggaactgatcgcttactgcagaaagtcctcccagaccggggctgctgttgacatgggcagggccgctttccgtacctccctcaatctcctgtccaacacgattttcagtaaggaccttactgatccgttctctgatagcgccaaggagttcaaggagctggtgtggaacattatgctcgaggctggaaagccgaaccttgtggacttttacccagccctggagaagttggaccctcagggcatcagaaagcgaatgaccgtgcacttcggtaaagtcattgagctcttctcaggtctgatcaatgagcgtactgaaacaggtaagacacaaatgctcgggacaacggacgtcatcgatgtgttgtctgattctaaggagactcgtaggatcgaccgcactcacattgaacgactttgccttgatctattcgtcggcggactgacacacatcaacaccttggtgtgggccatggccgaccacgtccgcacacggaagtattgcaagtcccgactgacccgcaccgtgatcggcaagggcaagttcagcaccaagcagaatattcagagactgccttacctgcgttgcatggttaaggaaaccctcagaatacaccccccagttcccttcctcatccctcgaaaggtggaacaagacgtggacgtctgcggttacactgttcctaaaaactcccaggtctttgtcaacgcatgggctatcggacgagatccggagacgtggcctaatcccctggagtttaagcctgagcgttttatggaatctgaagtggacatgcgaggccgcgacttcgagctcatacccttcggggccggtcgccggatctgtcccggagttacactcgctgttaggatggtcccggttatgctcggctccctcctgaactctttcgactggaagctggagggtggagctggacctaaggacttggacatggaagagaagttcggtatcacacttcagaaagccctgcctctcatggccgttcccattccattg

SEQ ID NO: 1096 - DNA, 1470 bp, Nepeta mussinii
atggacttccttactattaccgtgggtctggtgtctgcaattatcatcactttcatttacggattttccctgagtcgtcgaggcaagaacctgccccccggccccacacccttgcccctgatcggcagtctccacctgctcgggggacagccccacaagagccttgccagactggcaaatatctacggccctctgatgaggctccgcctgggtagtgtcaataccattgtggtgtcttccgccgccgtggcgcgagaagtcctccagaagcacgacctggctttctcatcccgaagcatccccgatgccctacatgcacacgatcacttcaagtactccgtcgtgtggctgcccgtggcctcgcgatggcgatcactacgcaagactatgaactcaaacatcttttccggcagccgacttgacgcgaatcagcacttgcgatctcgaaaggtggaagagctggtggactactgcagagagtgttctcgtaccgctgaggcagtgcatgtcggaagggctgcgtttcggacggtcctgaactcactctcgaacactattttctccaaggacctggccgaccctttcagtgactcaggcaaggagtttaaggaaattgtgagtaacattatgaaggaggctggcatgcctaacctcgtggattttttccccttcctggcccggtttgaccctcagggaatccgaagaagaactaccgtttactttggaaagattattcatctcttttcgggtctcatccaggagaagctcgaaaacaccaatcaggaagagaatatcgacgttatccagattcttctcaataccagtcgacagtccccccaggagatcgatcgaacacacatcgaaaggatgtgtctcgacctgttcgtcgccggaacggacacgtcttcctctacagttgagtgggccatggctgaagctcttaagaacctggagacgatgaagactgccaaggttgaactggagcaggtgatcggaaaagggaagacaattcaggagacagacgtaagccgactgccctacctgcaatgtatggttaaggaaacactacgcctgcatccacccgtgcccttcctgattcccagaaccgtggaccaagacgtggaggtccttggtcatgtcgtgccaaagaatagccgtgtgtttgtgaacatgtgggcaatcggacgagaccctgacgtctgggaaaaccccctggaattcaatccccgtcgattcctggactctgaggtggacgtgcgaggaactaacttcgagctcattcctttcggcgccggacggagaatttgccctggcctgcccctcgctatgcgaatggtccctgtaatgttggggtctttgctcaactcgttcgactggaagctagagggcggcgagaacctggacatggacgagaagttcggtatcaccctggagaaggctcagcctctccgtgtggttcccatctctctc

SEQ ID NO: 1097 - DNA, 1482 bp, Olea europaea
atggatttcctgacaatcgtgctgggactgctgttcgcgctgaccctaatccaggcgttccgttcgatttccacacgtggaaaaaacctgcctccgggtcccaccccgctccccatcatcggcaacctgcacttgctcggtgaccagccgcataagtcgctagcaaagctggccaagacttacggccctattatgtgcctccgatttggatccatcaatactgttgttattacttctagtgctatggctaaggaagttcttcagaagcaggacctggctttttcctctagacacatccctaacgcaatccacgcgcataaccagtttaagtattcagtcgtctggctacccgtcgcctctacttggagatctctccgcaagattctgaactcgaatatgttctcgggaaaccgattggatgctaaccagcacctgagagttcgaaaggtccaggagctgattacatactgtcgtaagaatagccaggctggagaggcagtcgacattggccgggccgcctttcgtacctcccttaacctgctgagcaacaccatttttagcaaggatctgaccgatcctttctcggactcggctaaggagttcaaggatttggtgtggaacgttatggttgaggctgggaaaccgaatcttgtggactttttccctgtcctcgaaaagctcgacccccttggaatccgacgcagaatgaccattcactttggcaagattattgagctctttggaggtctgattaacgaacggcttaagagacggatgtctgacaactctaagaatagcgacgtgctcgacgtgctgctggatacttctcaggagaacccagaggaaatcgacagagtgcacatcgagcgtctgtgcttagacttgtttgtggctggaactgacacaacgtctagcactctcgagtgggccatggcggagacgctcaagaaccccgctaccatgaaaaaggccaaggcggagctggaagaggttatcggtaaaggaaaagttttggaggaggccgatgtgtctagacttccctacctccggtgcatggtgaaggaggccctgagaatccacccccccgttcccttcctgatccctaggcgcgtggagcaagacgtggaagtatctggatatacagtgccgaagaactcccaagtgcttgtgaacgcctgggcaataggtcgagaccctaccctgtgggaaaaccccctggaatttaagccagaacggttcatggaatcggagctcgacatccgtggccgcgactttgaactgatccccttcggtgccgggcgacgaatttgccccggcctgcctctcgccatccgaatggtccctgtcatgctgggctcgctggtgaacagcttcgactggaagctggagggcggaatttcgccaaaggatctggacatggaggagaagtttggtattacactccagaaagcgaacccgctgcgggccgttcctacacccttg

SEQ ID NO: 1098 - DNA, 1482 bp, Sesamum indicum
atggacttcctgactattgtgcttggcctcctgttcacacttgtgctcgttcacggactccagactctttctgctagggccaagaaactccctcctgggcccacgcctctaccacttatcggctctctgcacctcctgggcgaccagcctcaccaatctcttgctaagcttgcgaagactcacgggcccctcatgtgtctccgcttgggatttattaacacggtcgttgtatcgtcggcagcaatggcgaaggaggttctccaaaaacaggatctcgtcttcagcagtagaaccataccggatgctattcacgcacacgaccagtttaagtactctgttgtctggttgcccgtcgcttcacgatggcgtagtctgcgtaaggtgctcaactcgaacatcttctctggctcccgtctggacgccaaccagcacctacgatgccgtaaggtgcaggagctcatcgcctattgcaggaagaattcacagaccggtgagccagtggacgtgggacgagccgcgttccgaacctcccttaacctcctttctaacaccatcttttcgaaggatctgacagaccctttttctgactctgccaaggaatttaaggacctcgtgtggaacattatggtcgaggctggaaagccaaacctggtcgatttctttccaatgctcgaaaagcttgatccccagggcatacgaagacgaatgaccattcatttcggaaaggtgatcgatctgtttagtggtcttatcaacgaacggctggaaaagggtaagactcagaacgctggtaactccgatgttatcgacatcctcttggcaacttctaaggaaaacccagaggagattgaccgagttcacatcgaacgtatgtgcctggatttgtttgtagctggcaccgacaccacatcgtctacgctggagtgggcaatggccgaggccctgaagaaccccgagacggtcaagaaggctaaggcggagctcgaagaggtgatcggtaagggcaaggtcctcgacgaggctgacatttcacgtttgccctacctacgctgcatggtgaaggagacgctaagaatccacccccctgtaccattcttgattccccgaagggtggaccaggatgtggaggtttgtggttacaccgttcccaagaactctcaggtcttcgtgaatgcctgggccattggtcgggaccccgatgtctggaaggaccccctcgaattcaagcccgagcgattcttggagtccgaactcgacatgcgaggacgagacttcgagctgattccctttggtgcaggacggcggatttgtccgggtttgcccctcgccgtgcgaatggtccccgtgatgctcggttcgctgctgaatagcttcgactggaaactggaaaacggcatcggtcccaaggaactggatatggatgaaaagttcggcatcaccctccagaaggctagacccctcagagctgtgcctcttcctctc

SEQ ID NO: 1099 - DNA, 1479 bp, Coffea canephora
atggactcgctgatggttgtcctggcttctctgctgtcgctgactttgattaaaggtctctcttccctggcgcgacgggctaagaaacatccgccgggacccacgcccctgccccttattggcaacctgcatctgcttggcgacctcccccatcagagccttgccaagctggccaagatccacggaccggttaccagtctgaaactcggacaactgacaactgttgtcatttcctcttcgagtatggctcgggaggtattgcagaaaaaggacctggccttcagttcgcgatccatccccgatgcggtccatgctcagaaccatagtcactactcggtcgtttggcttcccgtcgcatcgcgctggcgatccctgcgacgcattatgaactcaaatatgttttctgcaaactcgcttgacgccaatcaacaccttcgatgtagaaaggtgcaggagcttgttgactgctgtcagaagaactgtcagaccggcgaggccgttgatattggccgagcaggcttcatgaccagcctgaacctgctgtctaacacgattttttcgaaggacctggctgatccttactccgacactgccaaggagttcaaggaccttgtgtgggacatcatggtcgaagcaggcaagcccaacccggtcgacttctttcccctactcaagaaatttgaccccagaggtgtccgtcgacggatgagtgtacatttcgaaaaggtgctaaagctcttcgagggtttgatcaacgagcgactggaatccggaaactctggcgacgagggacgcgatgtcctggacgagctgctgaccacatccgaagagagctcccaggagtttgaccggatcgatatggtccacatgtttctagacctgtttgtggctggaacggataccacgagctctacactcgaatgggctatgaccgaactgctgaagaaccctgagaagatgagaaaggcacaggccgaaatcgccggaggaatcggcaagggcaaggccatcgaggaggctgatgtggcccgcctgccctacctgcagtgcattgtgaaggagaccctcagaattcatccccctgtgcctttccttatccctcgccgagtcgagcaggatgtggagctgtgtggatacaatgtgccaaaaggatcgcaggtcctagttaacgcttgggctatttgccgagatgagatcgtctgggaaaatgccctggtttttaagccggaacgtttcctggaatccgagatcgacattagaggccgagacttcgagctgatcccgttcggcgccggtcgacggatctgtccaggactccccctggccgctagagtagtgcccgtcatgctgggctcgctccttaactcctttgattggaagctggagggaggtaacacccccaaggatctggacatggaagaaaaatacggaatcactctccagaaggctctgccacttcgtgcagtccccctacctttg

SEQ ID NO: 1100 - DNA, 1485 bp, Dorcoceras hygrometricum
atggattggatcacaattgtcgtcgtgttgctttctgccctgactctttcccacgggtatcgagtgctgtactccacctgggtgaagaaacacccccctggacctactccgctccccatcatcggaaacattcaccttctcgggaaccagcctcataaaagtctggccaagctagctaagacacacggcccgctcatgcgtctcaggctaggcttcattaacaccgttgtcatatcttcttccgctatggccaaggaagttctccagaagcaggacttggcattctcatcccgatgggcccctgacgcactccacgcctgcgatcatagtaactacagcgtcgtttggctgcctgtcgccgcccgatggcgatccctccgcaaggtgcttacttctaacatcttctccggctcccgactggatgcgaaccaacacctgtcttctagaaaggtgcaagagctgatcgcttattgcggttcttcttctcaaacaggtgaggctgtcgatgtgggtcgcgcagcctttcgaacctccctcaatctactttccaacacgattttctctgttgaccttgctgacccctttagcgattccggcaaggaattcaaggatctcgtgtgtaacattatggtggaggcaggtaaaccaaacctggtggactactttcccttcctcgagaagatcgatccccaaggcattcggcgacggatgacatttcacttcgaaaaggtcattgagttgttctcctgcctgattgctgagcgactggagaagggcgagtcgaaggattctgagaccaacgacgtcatagacgtgttgttagctacctcgaaggagaatcctgaggaaatggacagaactcatatcgagcggctctgtctggacatgtttgtcgctggaactgacaccactagtaacaccctcgaatgggccatgactgaggccatccggaaccccgagattatgaaaaaagctaagtcagagctggaggaaattgtgggaaagggcaagatcatttccgaagaggaggtccagcgacttccctatctgagatgtatggttaaggagaccttgcgtatccaccctcccgtaccttttcttatccctcgaaaggtcgaggaggacgtccaagtgtgcggttacacagtccctcggaactcacagatactggttaacgcgtgggccataggacgggacggagacgcctggaagaacccacttgaattcaaacctgagagattcctcggctcggaaatagacgtgaggggccgagactttgagctgatcccgttcggcgccggacgacgaatctgccccggtctgcccctagccattcgtatggttcctgttatcctgggttccctcctgaacagtttcgattggaagctggaaggaggttcctctcccgacgaggtcgacgtggaggagaagttcggtattactctgcagaaagctattccactcagggctgtaccaattcctctg

SEQ ID NO: 1101 - DNA, 1479 bp, Gentiana rigescens
atggactacctgaccattgcactcggttttctgttcgccctaaccctgtaccaggccttgatttctttctcccggaagtctaagaacctaccccctggtccggcaccacttccctttattggaaatcttcacctgctgggtgaccagccacacaagtctcttgcaaagctagcgaagaagcacggacccatcatgggcctccagttcggacaagtgacaaccattgtcgttacaagctccggcatggccaaggaggtccttcagaagcaggacctggctttttcgtcgcgatccgtgcccaacgcacttcacgctcacgatcaatacaaatacagcgtcatttggcttcccgtggccagccaatggaggtccctccggaaagtgctgaactctaacatcttctcgggaaatcggctggacgcaaaccagcatctaagatgccgcaaggttcaagagctcattgcttactgccgaaagaactgccagacaggcgaagccgtcgatcttggtcgggcggcctttcgaactagtctgaacctcctgtcgaataccatctttagcaaggatctcaccgatccttacagtgatagcgctaaggaatttaaagatctggtttggaatgtgatggtggaggctggcaagcccaatctcgtcgacttcttccccgttctggacaaggttgaccctcagggaattagaaagcgaatgactttccacttcggtaaaatcctccagctgttcggtggcctcatcaatgagaggttgcagcagaacaaggcgaagggcgctcacaaagacgtgctcgatgtgctgcttaagacctcgcaggagactcccgacgagctcaaccgaacccatatcgaacgaatgtgtctcgacctctttgtggctggaactgataccacttcctccaccctggagtgggctatggcggagatgctgaagagcccggacaaaatgaacaaggccaaggaggagctggcacaggtgatcgggaaaggcaaggccgttgaagaggccgatatcgcgagcctcccatacctccggtgcgccataaaggaaacgctgagaatccaccctcccgtgcctttcttaatccctcgacggactgagcaggaggtcgaggtttgtggatacactgtacctaaaaactcccaggtgtttgtcaacgtctgggctatcggccgagatgagaccacgtggcctgacgccctagagttcaagcccgagcgttttctggaaagtgaaattgacatgcggggtcgggacttcgagcttctgccctttggcgccggtcgacgaatctgccccggcttcccattggcggtgagaatggtgccggtcatgcttgggtcactgctaaattccttcgactggaagcttgagggtggaattgcccccaaggatctcgacatggaggagaaattcggtattacgctacaaaaggctcatccccttcgagctattcccacctccttg

SEQ ID NO: 1102 - DNA, 1479 bp, Vinca minor
atggactatctcacaatagcgctgggcctgttgtttgcgctgaccttctaccagggtctcacttacctctcaagaaggtcgcagaagctccccccaggcccattgcctctgcctatcattggtaatctgcatctgcttggggatcaccctcacaaatctcttgccaagctttccaagaagtacggtcccattatgtcacttaagctgggtcgaatcactactctggtgattagttcttccacgacagccaaagaagttttgcagaagcaggaccttgcattttccagtagatccgtgcccaacgctctccacgctcataaccagtttcagtattctgttgtctggcttcccgtcgcctcgagatggagatcgctgcgcaagatcctaaactcaaatattttctcaggaaacagactcgacgctaaccagcacctgagatgccgaaaagtcgaggaactgatcgcatactgccgaaagaactgccagtcgggtgaagctgtggaccttggcagagccgccttcaggacctccctgaacctcttgtcgaacacgatcttcagtaaggacctcactgacccatactcggacagcgccaaggaattcaaggacctggtgtggaatattatggtggaggccggcaaacctaatctagttgactttttccccgtgctcgagaaggtcgacccccagggcattcgccgtaggatgaccgttcatttcgggaaggttatccagctcttcaacggccttatcaatgagcggctagacaagagaaagagtcggggcggttacaacgatgtgttggatgtgctgcttaccactacagaagagaaccctgaagagatcgatcggacccacattgagagaatgtgcctagatctgttcgtggctggtacagacacgacctcgtctacactcgaatgggcaatggccgagatgctgcgcaatccagagaaaatgaagaagactcaggaggagctcgcagaggttgtcggaagaggaaaactaattgaggagggtgacgtctcgcgactcccgtaccttcgatgtgtggtcaaggaaactctgcgggtccacccccccgttccctttttaattccgcgaaaggtggtacaggatgtcgaggtgtgtggttacaaggtacccaaaggatcgcaagtgctcgtaaacgcttgggccattggccgggacgagactttctggaaggacgccctgggatttaagccggagagattcctggagtccgagctggatacgcgaggacgtgacttcgagttgattccttttggcgccggcagacgaatctgccctggtcttcctttggcgaaccggatggtgcctgtgatgttgggcagtcttctgaactcgtttaactggaagctggagggaggaattgcccccaaggacctggacatggaggaaaagttcggtatcacccttcagaaggctcacccactccgagcagtgccctctcccctg

SEQ ID NO: 1103 - DNA, 1479 bp, Ophiorrhiza pumila
atggactacctgactattgccttggggctgcttttcgcccttaccctgatccagggttggtcttttctctcgcgaagatccaagaagctgcctcctggaccaactccgctgccaataatcggaaatctgcatctccttggggaccagcctcataagtccctcgccaagctcgcaaaaacccacggccccctcatgtcacttaagctcggtcagattaccaccctcgcaatctccagttctggcatggcaaaggaggttctgcagaaacaggatctagctttcagctcccgatctattcccgacgctatccacgcccataaccagttccagtactctgtggtctggcttcccgtggctacccgatggcgaagtttgcgcaagattctcaactctaacatcttctcgggcaaccgactggacgctaaccagcacctgagatgccggaaggtgcaggaactcatcgcttactgccgaaagaattgtcagacgggagaggccgtcgacataggtcgcgctgccttccggacatcgctaaacctcctatcgaacacgattttctccaaggatttaactgatccatacagtgattccgctaaggagtttaaagacttggtgtggaacatcatggttgaagccggaaagcctaatctcgtagactttttccctgtcctcgagaaattcgacccccagggaatccggcgaagaatgaccatccatttcggaaaggtgctggagatgttcggtggactgatcaacgagagactggacaatggcaaatccagaggaggtaacaacgatgttctggacgtcctcctcaacgcttctgaggagacaccggatgagatcgatcgcacccatatcgagcgactgtgtctcgaccttttcgttgctggtactgacaccacctccaacaccctcgaatgggctatggcggagatgcttaagactcctgagaagatgaagaaggcgaaggcggagctcgctgaggtcattggcaagggcaaggctatcgaggaagctgatgtgtcacgacttccctacctcagatgtattgtcaaagaaaccctgagattgcatccacccgtcccctttctgattccccgaaaagtcgagcaagacgtcgaggtgtgcggctataacgtgcctaagggaacccaggtgttggtgaacgcgtgggctattggccgtgacgagaccacctgggaaaacgccctcgagtttaaacctgagcggttcctggagtcggagcttgacattagaggccgtgacttcgaacttatcccattcggtgccggtcgacgaatctgtccaggtcttccgctcgcggtgcgcatggtccctgtgatgcttggctctcttctaaactccttcgattggaagctcggaggaagcatcgcccctaaggaccttgacatggaagagaaattcgggattaccctgcagaaggcgaaccccctgttggctgtgcccatttcctta

SEQ ID NO: 1104 - DNA, 1479 bp, Rauvolfia serpentina
atggattaccttacaattactttgggactcctcttcgccctcaccttctatcagggactgtcctacctgtcacgacgatctaaaaagctcccccctggaccggctccccttcccatcatcgggaacctccacatgctgggggatcagccccataagtctctggccaagctctcaaagaagcatggtccgatcatgtctcttaagctgggacaaatcaccacagttgtggtgtcttcttctggaatggctaaggaagtcctgcagaaacacgacttggcctttagtagtcgatctattcctaacgccctgcacgctcataaccagtatcagttcagcgtcgtttggctccccgtcgcttcccgttggcgatcgctgcgaaagaccctcaactcgaacattttctcgggtaacaggttggatgccaatcagcacttgagatcccgaaaggtcgaagagttaatcgcttactgccgaaagaactgtcagacaggcgaggccgtcgacgtcggccgggcagccttccggacatcgttgaacttgctctccaacctcatcttctccaaggatctgaccgatccttattcggattcagctaaggaattcaaggacctcgtctggaatatcatggtcgaggctggaaagccaaacttggtcgattattttcccgtactcgagaaagtcgaccctcagggcatcagacgacgaatgactgtccatttcggaaaagttctcaagctgttcgacggtcttgtgaatgagcgactagagcagcgtcgtagccgaggaggaaagaatgatgtgttggacgtgctgcttactaactcagaggagaaccccgaggagattgatcgaacgcacattgagcggatgtgcttggacctattcgttgcaggtactgatacgacttcatctactcttgagtgggccatggccgagatgctgaagaaccctgataagatgaagaagacgcaggccgagctagctgaggtgatcggcagaggtaaggcgattgaggagagcgacctccctcgactgccttaccttcgatgtgttgtgaaagaaaccctgcgaattcaccctccggtccccttcctgattcccaggcgagtcgagcaagacgttgaggtgtgtggctataaggtccctaagggatctcaagtcctggtcaacgcgtggacaatcgggcgagacgaggccgtctgggaggacgctctagcttttaagcccgaacggttcctcgagtccgagctggacattagaggacgagatttcgagttgattccattcggagctggtcgtagaatttgccctggtctacccctcgccttgcggacagtccctctcatggtcggctctctgctcaactcgttcaattggaagctggagggcggaatcacccctaaggacctggacatggaagaaaagttcggcataaccctgcagaaggcacatcctctgagagccgtgcctatccctttc

SEQ ID NO: 1105 - DNA, 1479 bp, Cinchona calisaya
atggactatctgacaatcgttctaggtctgctgttcgccctgaccctgtaccaaggactctcctctttatcccgcaaggctaagaagctgccccctggccccactcctcttcctatcattggaaacctgcacctcctcggtgaccagccgcataaatctctcgccaaactggccaagaagcacggccctctgatgtctctgaagctcggacagattactaccgtggtcgttacgtcctcggacatggcaaaggaggtcttgcagaagcaagacctcgccttctctttcagatctatccctgacgccctacatgctcacgaccaatacagatactctgtcgtatggctcccggtcgcgagtcgatggcgcagtttgcgaaagatactcaattctaacatcttctccggaaacagactggacgccaaccagcatttgcgtctcaaaaaggtccaggagctggtggcctattgtagaaaaaactctcaggttggagaagccgttgacgtcgggcgtgctgccttccgaaccagcctgaaccttctttcaaacactctcttctccaaggacctcaccgacccctactctgactccgccaaggagtttaaggacctggtctggaacattatgttggaggcgggaaagcctaatctggtcgatttcttccccgtgctggagaaaatcgacccccagggcatccgacgacgaatgactattcacttcggtaaagtgctgaagctgttcggcggcttagtggatgagagactggaacaaggcaagtccaagggcggtaactcagacgtcctggacgttctgctgactacctcggaggaggcccctggagagattgatcgaactcacatcgaacgaatgtgcctggacctgttcgtcgccggaactgatacgacatctaatactctggagtgggccatggctgaagttcttcgaaaccctgaaaagatgaagaaggccaaagccgaactagctgaggtgattggaaagggcaagctagtcgaggaagcggacgtctctcgactaccctacctgcgatgtatcgttaaagaaactctgcgtatccacccgcccgtccccttcctgatcccccgacgtgtggatcaggatgtcgaagtgtgtggatacaacgttccgaagggtagccaggtgttggtgaacgcgtgggctatcggtcgtgatgagaccgtctgggagaacgccttggcatttaaaccagagagattctgggagagcgagctcgacatccgaggccgagacttcgaactgatccccttcggtgccggtcggcgaatctgccctggactgcctctcgccgtgagaatggtgcccgtgatgttgggatctctgctcaacagctttgactggaagctcgaagcaggtatcgccccgaagggtctggacatggaggagaagttcggcatcacccttcagaaagcctaccccctccgagccgtgccaatctccctg

SEQ ID NO: 1106 - DNA, 1479 bp, Tabernaemontana elegans
atggactacctcaccctggtcctcggcctgcttttcgccctcacattctaccagggcctcagctacctgtcccgaaagagtaagaaactcccccctggtcccgcaccgcttccttttatcggaaacctccacctgttgggtgaccagccccataagtctctggctaagctctctaagaagcatggccctctaatgagtctcaagttgggacacatcaccacggtcgtcatttcctcttctggaatggcgaaagaagttctccagaaacaggatctagcattttcttcacgttcggtccctgacgctttgcatgctcataaccaattccagttttcagtggtttggctgcctgttgcctcccgatggaggtccctgcgcaagattctgaactctaacatcttttcaggaaaccgcctggatgcaaaccagcacctgcgatgccgcaaggtccaggaattaatcgcctattgccgaaaaaactgccagactggcgaggccgttgatgtgggacgagccgcctttcgaacctcgcttaacctcctctccaacaccattttctcaaaggatctgaccgatccgtactcagactctgccaaggagtttaaggacttggtctggaacattatggtcgaggcaggtaagcccaatctggtggactttttccctgtcctcgagaaggtggacccccagggaatccgaaagagaatgaccgtacacttcggtaaggtccttaagctgtttaatggattgattaacgagagactggaacagaagagactccagtcaggtaacaacgatgtgttggacgtactgctgacaacttctgaagaatctcctgaggagatcgatcggacccatatcgagagaatgtgccttgatctgtttgtggctgggactgacaccacatcatccacgctagagtgggcaatggcagaaatgttaaagaaccctgacaaaatgcagaagactcaggccgagatcgccgaggtaattggaaaggggaaggctatcgaggaggccgatgttgcccgattgccctaccttcgatgtgttgtgaaagagaccctgagaatccaccctcccgtgcctttcctgattcctcgaaaggtcgaccaagacgtcgaggtgtgtggatacaaggtccctaaaggctcccaggttctcgtcaacgcctgggccatcggacgagatggaactgtttgggaggatccactcgcgttcaagccggagcgttttttcgaatcagaaatcgacattagaggcagggactttgaggtcatcccatttggagcaggccggcgcatttgtcctggcctgcctttagcagctcgaatggtgcccgtcatgctgggctctctgctgaactcgtttaactggaagctggagggaggcatcgcccccaaggatcttgacatggatgagaagttcggcattaccttgcagaaggctcatccactcagagctgtcccttcccctcta

SEQ ID NO: 1107 - DNA, 1479 bp, Catharanthus roseus
atggactacctcactatcattcttactctactgttcgcgcttacactttacgaggcattttcttacctctctcgtagaacgaagaaccttcctcctggaccttcgccgctgccttttattggaagcctgcacttgctgggagaccagccccacaagtcccttgccaagttgtcaaagaagcacggtccaatcatgtccctgaaactcggacagattacaactatcgtgatatcctcgtccactatggcgaaggaggtactgcagaaacaggacttggcctttagttctcggtcagttcctaacgccctccatgcacacaaccagttcaagttttcagttgtttggctgccagtggcaagccgatggcgttctctgagaaaagtcctcaactcgaacatctttagtggaaatcggctcgacgctaaccaacatctgcgtactcggaaggtgcaggaacttatcgcttattgccgaaagaactcgcaatctggcgaagcagtcgatgtcggacgggccgccttccggaccagtctgaacctactatctaacctgatcttcagtaaggatctcacagacccctactccgactcggccaaggaattcaaggacttggtctggaacattatggtggaggccggaaagcccaacctcgtcgatttcttccctctccttgagaaggttgacccccagggaatccggcatagaatgaccatccatttcggcgaagtccttaagttattcggtggccttgtgaatgaacgcctcgaacaacgacggtccaagggtgagaaaaacgatgtccttgacgtgctgttgacaacctcccaggagtctcccgaggagattgaccggacccacatcgagagaatgtgcctcgacctcttcgtcgccggaaccgataccacctcctctacactggagtgggcgatgtctgagatgttgaaaaatcccgacaagatgaagaagacacaggacgagcttgcccaagtgatcggccgtggtaagacgatcgaggaatcggacattaatcgcctcccttatctgaggtgcgtcatgaaagaaactctgcgaatccatccccctgttccttttcttatccctcgtaaggtcgagcaatcagtggaagtgtgtggctacaatgttcctaagggctctcaggtcctagttaacgcttgggccattggcagagacgagacggtgtgggacgacgccctggcttttaagcccgagagattcatggaaagcgaactggatatcagagggagggatttcgagctaatcccctttggcgccgggcgacgaatttgccctggcctgccactcgccctccgaacagtccccctcatgctcggctcacttctcaactcgtttaactggaaactcgagggtggaatggcccccaaggatcttgatatggaggagaaatttgggatcacgctgcaaaaggctcacccactccgtgcagtcccctctacactc

SEQ ID NO: 1108 - DNA, 1479 bp, Catharanthus roseus
atggattacttaactatcatcctcactcttctgtttgccctcaccctttacgaagcattcagttacctgtcaagacgcacgaagaatctccctcctggcccctctcccctcccgtttatcggtagtctgcacctccttggagatcagccccacaagagcctcgcaaagctaagtaaaaagcatggcccgatcatgtctctcaagttgggacaaattaccacaatcgtgatttccagctccacgatggcaaaggaagtactgcagaagcaggacctggctttctcctctcggagtgtgcccaacgccctgcatgcccacaaccagtttaagttctctgtcgtgtggctccctgtggcttcgcggtggcgaagccttcggaaggtgctcaactccaacatctttagcggtaacagactggatgcaaaccaacatctccgtacacggaaggtgcaggagctgatcgcctactgtcggaagaactcgcaaagtggcgaggcagtcgacgtgggtcgagccgcattccggacttccctaaacctcctctctaaccttatattttctaaggatctaactgacccctattctgatagcgccaaggagttcaaagatctcgtctggaacataatggtcgaagctggcaaacccaacctcgtcgacttcttccctctcctggagaaggtggatccgcaggggatccgacataggatgactatccacttcggagaagtgctcaagctttttggaggactggtcaacgaacggcttgagcaacgtagatctaagggagagaagaatgacgtgcttgatgtgttgttaacgacttcccaagagtccccggaggagattgaccgaactcacattgaaagaatgtgtctcgacctgtttgtggccggtacggacacaactagttcgactcttgagtgggccatgtccgaaatgctgaagaatcccgacaagatgaagaagacgcaggacgaactggctcaggtgattggtagaggaaagacgattgaggagagtgacatcaacagactaccctacctccgatgtgtgatgaaggagacccttcgaattcacccccctgtcccatttctcatccctcgaaaggtcgagcagagcgtcgaagtatgtgggtacaacgttccaaagggaagtcaagttttggtcaacgcctgggctatcggacgggatgagaccgtgtgggacgatgcgcttgccttcaagcccgagagattcatggagtccgaactagacattagaggcagagacttcgagcttattcccttcggcgccggacgaagaatctgccctggtctgcccctcgcattgagaaccgtcccgctgatgttgggatccctgctcaactctttcaattggaagctggaggggggtatggcccccaaggacctcgatatggaagaaaaattcggaattaccctgcaaaaggctcaccccttgcgcgcggttccttctacgctg

SEQ ID NO: 1109 - DNA, 1479 bp, Catharanthus roseus
atggactaccttaccatcattctgacgctcctcttcgcgttgaccctgtacgaggctttctcttacctctcaaggcgaacgaagaacttaccccccggaccgagtcctctgccttttatcggatcgctccacctgctgggtgatcagccccacaagtctttggctaaactctctaagaaacatggtccaatcatgtcgcttaagctgggccagatcactacgattgtgatctcttcgtctacaatggcaaaggaggtgctgcagaaacaggatcttgcattctctagccggtccgtgcccaacgccttgcacgctcataaccaatttaaattttctgtcgtttggctgccggtggcgtctcgctggcgaagcctgcgaaaggtactgaactctaacattttttctggcaaccgactcgacgccaaccagcatctgcgaactagaaaagttcaggagttgattgcctattgccgaaagaactctcagtctggtgaggctgtcgatgtggggcgggccgccttcagaacctctttgaaccttttgtctaaccttatcttctctaaagatctgacagatccctactccgactctgcgaaggagttcaaggacctagtgtggaatatcatggtcgaggccggaaagccaaatctcgttgatttcttccctttgctcgagaaggtggaccctcagggaattcgacatcggatgacaatccattttggtgaagtgctgaagctattcggtggacttgtgaacgagaggctggaacagcgacgttcgaagggagagaagaatgacgtgctggacgtgttgctaacgacgtcccaggagtcccccgaagagatcgaccgtacccacattgaacgtatgtgcctggatctctttgtcgctggtactgacactacctctagcaccctagagtgggctatgagcgagatgctaaagaaccctgataagatgaagaaaacgcaggacgagctggcacaggtgattggacgaggcaagaccattgaagagtctgatattaaccgtctgccctacctgcggtgcgtgatgaaagagaccctgcgaattcacccacctgtgccctttctcattccacgaaaagttgagcagtccgtcgaggtctgtggttacaacgttcctaagggttctcaagtgcttgtcaacgcttgggccatcggcagggacgagaccgtgtgggacgatgctcttgcatttaaaccagagagattcatggagagcgagctggacattcgtggccgagactttgagctgattccctttggcgctgggcgacgaatttgccctggcctgcctttggccctgagaactgtgcccttgatgctgggttccttgctaaacagtttcaactggaagcttgagggaggcatggcgcctaaggatctggatatggaagaaaagttcggtatcaccctgcagaaggctcaccccctgcgggcggtcccgagcaccctc

SEQ ID NO: 1110 - DNA, 1479 bp, Catharanthus roseus
atggactacctgactatcatcctcacactgctatttgcactaactctctacgaggccttctcttatctgagccgccggacaaagaaccttccccccggtccctcccctctgccgttcatcggatccctgcacctgctgggagatcagcctcacaagtccctcgccaagttgtctaaaaagcacggaccgatcatgtccctgaaactcggacagattactaccattgtgatttcttctagtaccatggccaaggaggtgctccagaaacaggacctggccttctcctcacgatctgtgcccaacgccctacacgctcacaaccagtttaaattctcggttgtgtggctcccggtggcatctcgctggagatcactgcgtaaagtgctcaactccaacattttttccggaaatcgacttgatgccaaccagcacctgcgaacgcgaaaagtgcaggaactaatcgcctactgcagaaaaaattcgcagtccggtgaggccgtggacgtgggtcgtgccgcattcagaacctctctgaatcttctcagcaacttgatcttttccaaagatctaactgacccttacagcgattctgccaaggaattcaaggacctggtgtggaacatcatggtcgaagccggcaagcccaacctggttgatttcttccctctcttggagaaggttgaccctcagggtatccggcaccgaatgacgatccatttcggtgaggtactgaagctcttcggcggcctagtcaatgagcggcttgagcagcgacgaagcaaaggcgagaagaacgatgtcctggatgtcctgctcacgacctctcaggagtcacccgaagaaatcgatagaacccacattgagcggatgtgtctggacttgttcgtggccgggaccgacaccaccagttccaccctggagtgggccatgtctgagatgctcaagaacccggacaagatgaagaagacccaggacgagcttgctcaggtgatcggacgcggcaagacaattgaggaaagcgacattaaccgtctgccgtatctgagatgtgtcatgaaagagaccctgcgaatccatccccccgtgcccttcctcatccccagaaaggtggagcagagcgttgaggtgtgtggatacaacgtccccaaaggctcacaggttctggtaaatgcttgggcgatcggtcgagatgagactgtatgggacgacgctttagctttcaaacctgaacgcttcatggagtcggagttggacattcggggtcgagactttgagctgattcctttcggcgcagggcgacgcatttgtcccggtctcccccttgcccttcgtacggtgcccctgatgctcggaagcctgctcaacagtttcaactggaaactggagggggggatggctcctaaggatctggatatggaagagaagtttggcataactcttcagaaggctcatcctttgcgcgccgtcccttcgactttg

SEQ ID NO: 1111 - DNA, 402 bp, Catharanthus roseus
atggcgtctgaccagaagctgcacaagtttgacgaggtgtctaaacataataagaccaaggattgctggctgatcatcaacggcaaagtttatgacgttactcctttcatggacgaccaccctggtggtgacgaggttttgctcagcgctaccggtaaagacgcgacaaacgactttgaggatgttggtcattccgattcggctagggagatgatggacaagtactacattggagagatggatatggctaccgtccctttgaagcgtacttacattcctccccaacaggcacagtacaaccccgacaagacacccgagttcgtcattaagatcctacagttcctggttccactgctgatcttgggcctggccttcgctgtgcggcattacaccaaggaaaag

SEQ ID NO: 1112 - DNA, 330 bp, Yarrowia lipolytica
atgattattaacggtaaggtgtacgacatttcatccttcgttgatgaacatcctggaggagaggaagtgcttctggacgccggcggaacagaagccactaacgcttttgacgacgtgggtcattccgaggacgcctacggaatcctgaacgacctatacgtcggagaggtggatccgtcggaagatgtcattcgaaagacccataccgttaagacgtcatatgaggatggagagtcagtgggggatgaccacggctctagttctatgatcttcctcatcgttgccgccgcagttgccgccgccgcttttttctatctgcagggacagaag

SEQ ID NO: 1113 - DNA, 414 bp, Nepeta cataria
atgcccactcttacgaagctctacacgatggaagaggcctcccagcataataccaacgaggattgctggatcgtcattgatggtaaggtctacgacgtgtcaagctacgtcgacgatcatccgggtggagacgacattctagtaggcgccactggaaaggatgccactgacgagttcgaagatgcaggacactccaagtcagcacgagagttgatggagaagttctgcatcggcgaactcgaggaaactacccccagtatcccagagcttgacatcgttagtcagaagcagaagatgaatgatctcccccataagattctgaattttacgaagcagtattggttcgcctcgattaccgtcgccggtctctcagttgtcgtgggatacctttgcatccggaaaaagcagactaca

SEQ ID NO: 1114 - DNA, 402 bp, Catharanthus roseus
atggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaatttgtgattaaaattctgcaatttttggttccattattgattttgggtcttgcatttgcggtacgtcattacaccaaagaaaaa

SEQ ID NO: 1115 - DNA, 414 bp, Nepeta cataria
atgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaatattggttcgcatcaattactgtggcaggtttgtccgtggtcgttgggtatctttgcatccgaaaaaagcaaacaact

SEQ ID NO: 1116 - DNA, 408 bp, Artemesia annua
atggcatccgatcccaaaaattttgtgttcgatgatattagtaagcacaataagacaaaggattgttggcttattattgatggaaaagtgtacgatgtaaccccattcatggaggatcacccaggaggggacgaagtgctcctagcagctaccggtaaggatgcaacagacgactttgaagatgtcggtcatagcgacgatgcaagggaaatgatgcataaatactacattggtgaagttgataaagctactgttccgaaaaaaagagcctatgttcctccagccgatagacactacaatcctgataaaacccaagattttatcgtgaagatattgcagtttctcgttccgctagttatcttgggtctggccttcgccgtcagatcttatacaaaagaaagatcagca

SEQ ID NO: 1117 - DNA, 402 bp, Arabidopsis thaliana
atgtcttcagacagaaaggttctatctttcgaggaggtatccaaacataacaaaacaaaggattgttggctaataatctccgggaaagtgtatgacgttaccccattcatggacgatcatcctggtggtgacgaagtcttattgagcagcactggtaaagatgctactaatgatttcgaagatgtgggtcattcagacactgcaagagatatgatggataaatattttatcggtgaaattgatagcagttccgttcctgctaccagaacttacgttgctccacaacagccagcatataaccaagataaaacacccgaatttataattaagattttgcaatttctcgtgcctattttaatattgggtctggcactagtcgtcagacattacactaaaaaagac

SEQ ID NO: 1118 - DNA, 1080 bp, Catharanthus roseus
atggccaagtctcctgaagtcgagcatcctgttaaggcttttggatgggccgcacgggatacctccggccacctctctcctttccacttttcccgacgtgcgaccggcgaacacgacgtccagttcaaggttttgtactgcggaatttgtcatagcgacctgcacatgatcaagaacgagtggggtttcaccaagtatcccattgtgcccggccacgaaattgttggtatcgtgactgaagtgggttctaaggtggagaagttcaaggtcggtgacaaggtgggagtcggatgtctcgtgggatcttgcaggaagtgcgatatgtgtactaaggacctcgagaattattgtccaggacagattctgacttactcggctacgtacaccgacggcactaccacctatggaggttacagcgacctgatggttgctgacgaacatttcgtgattcgatggcctgagaacctgcccatggacataggagctcctctcctctgtgctggaatcactacctactcccccctacgctacttcgggctggacaagcccggaacacatgtgggcgtggttggtctgggtggccttggacacgtcgctgtgaagttcgctaaagctttcggtgccaaggttaccgtcatctctacttctgagagcaagaagcaagaggctcttgaaaagctgggtgccgattcgtttctggtttctagagaccccgagcagatgaaggccgctgctgcgtctctcgacggaatcatcgacacggtttcggctattcacccaattatgccgttgctatctattctcaagtcgcacggtaagctcattctggtcggcgctcctgaaaaaccgctagaattaccctcttttcctttgattgcagggcgaaagattatcgcaggctctgccatcggaggactaaaggaaacacaggaaatgatcgatttcgcggctaagcataacgtgcttcccgacgttgaattggtctcaatggactacgtcaacaccgctatggagcgactgctgaaggcagacgtgaagtaccgctttgtgattgatgtggctaacactttgaagtccgcc

SEQ ID NO: 1119 - DNA, 1134 bp, Catharanthus roseus
atgacaaagactaattctcccgccccctctgttattacttgtaaagctgctgtagtctggaaatccggcgaacctcccaaggttgaagagatccaagtcgatccaccgaaagcttccgaagttagaattaaaatgttatgcgctagcttatgtcacaccgattttctcgcctgtaacggactgcccgttcccttgttccccagaattccaggtcatgaaggcgtcggtatgattgagtcggtcggtgaaaacgtcacgaatctgaaagaaggagatatagtgatgcccctgtacttaggtgaatgtggtgagtgtctgaattgcaaatctggcagaaccaatttgtgccataaataccctttgggcttttctggcctccttttggatggcaccagccgcatgagtattggagaacaaaaggtttaccatcacttcagctgttctacgtggtccgaatacatcgtaattgaagctgcatacgcagttaaggttgatccaagagtgtcattgccacacgcttcttttttatgttgtggtttcactacaggttttggtgctacctggcgagatgtcaatgtcgttaaaggcagtaccgttgccgtgttaggtttaggtgcagttggtctaggcgctgttcaaggcgctaaatcacagggtgcaagcagaataattggtttagacataaatgataaaaaacgagagaagggtgaagcgttcggtatgactgaattcatcaaccctaaaggctccaataaaagcattagtgaattaatcaatgaagcaaccggtggtttaggattggactacgtttatgaatgtacaggagtgccagcgttattaaatgaagccattgaatcctccaaagtgggtctgggaacagctgtactgataggtgcaggcttggagacaagtggcgaaatcaaatttatacctcttttatgcggaagaactgttaaggggtccatctacggtggagttcgtccaaagagtgatttaccaacactgattgaaaagtgtatcaataaggaaatccccatggacgaattaatgactcatgaagtgtcactatctgaaattaacaaaggtttcgagtatctaaaacatcccgactgcgtgaaagtagttataaagttt

SEQ ID NO: 1120 - DNA, 1128 bp, Nepeta cataria
atggcagataatacgaatccaggcgttataacatgtaaggccgctgttgcttggaagccactggaaccgctaaaggttgaagaaatccaaattcaaccgccaaaaccgacggaggttcggatcaaaatgttgtacgcgtcgatttgccatacagacacggtctgctggacggggattctttatgatatgtttcctagagttctgggtcatgaaggtgtaggggtcattgagtctgtcggagaagaagtcaccgacttaaaagtaggtgatactgttatgccattgtatgttggcgaatgtgggaaatgcccaaattgtgcgtctggtaaaagtaacttctgtagcaattatcccctgacactaggtctgatggcggatggtactacgcgtatgagcgctaaaggtcaacaattgtatcaactgttttcttgttcaacttggtctgaatacgcagttattgagtccaattatgttgttaaagttgaccctaagttgtcattatcgggggcctccctactcacctgtggtttcactaccggttatggtgccgtttggaaggttgttaattttgaaaagggctccactgtggcagttgtcggactaggagccgtcggtttcggagctgtgaaagctgcgcaaatattaggtgcatcaaaaattattggcgtagatataaacgaaacacgaagggataaagcaaaggccttaggagttactgactttatcaacccgaaaagttctgataaaaccatgtcacaactaattcaggaggccacagggggtctgggggttgactgttgtatcgagtgcactggtgttccgtccctcctaaatgaggctatagcttcgacgaaggtaggatcaggtgaagtcgtattgattagcgctggggatgagcagaatactgaacttaattacgttccgttattattaggaagaacagtaaaaggcaccatatacggaggtgttcgtatacattctgacctacacaaaattgttgacaagtgtatttctaaggaaattgatttagacgagataataactcatgaggtgtctttagctgatgtaaataaaggttttttggagtatatgaagcaaccagactgtgtcaaagtgatcattaagttt

SEQ ID NO: 1121 - DNA, 1131 bp, Sesamum indicum
atggctaatacttctagtacttctccagtaataacctgtaaggctgccgtgattaggaaacccggggaaccacttcaggtggaagaaattcaagtggatccacctaagccaactgaggttaggataaagatgctatgcgccagtatgtgtcataccgatatcttatgttgtaatggctttcccgcacctctgttccccaggattccaggacatgaaggcgttggtgttgtggagtctgtaggtgatgaagtaacacatgtaaaggtcggtgatacggttatgccactttacctcggagaatgtggtgaatgtcaaaattgttcttcaggccgtacaaacttatgtcataaatatccattagatttcagcggtttgatggcggatggcacaagcaggatgagcgtgggtggcgaaaaaatataccatgtattctcgtgttccacttggagtgaatatatcgttctcgagagctactatgccgttaaagttgatcctcggttgtcgcttccacacgcctcctttttatcttgtggctttacaactggctttgggtcgacatggagagaagttaatgtaaaaaaaggatcgacagttgccgttataggtctaggtgccgtgggtctaggcgcagtcaagggtgcccagatacaaggcgccgcaaagattattggtatagatattaatgaattgaagcaagaaaaagccaaggctttcggaataaccgaattcatcaaccccaaattatctgacaggagcgtttctgaattaattaaagaagccacaggtggcttaggtgtggattactgcatagaatgtacgggtgtgccagcattgctgaacgaagcaatcgaagggagtaaggttggtttaggcacagttgttctgataggtgctggcctagagaaatctgtagaattaaattatatccccctactatgtggtagaactgttagaggttcaatctacggtggagttagagcacaatccgatctgcctaaaattgtagagaaatgtgttaacaaagagatcgatttggatcaccttatcacgcatgaagtgtcactggcagagatcaacaaagcattcgaatatatgaaacatcccgattgtgttaaggtggtgattaaattt

SEQ ID NO: 1122 - DNA, 1125 bp, Camptotheca acuminata
atgtcaaaaacatcgagtcaagttataacgtgcaaagccgccgttagttggggtgctggcttgccgctaaaagtcgaagaaatccaagtggaaccccccaaaagctctgaagtccggttgaaaatgctatgcgcatctttgtgccatacagatatactttgttgtaatggtctcccagtcccattattcccgagagtacctgggcatgaaggtgtcggcatggttgaatctgtaggagaaggtattaccgggttaaaggaaggtgatatagtgatgccaacatacattggtgaatgtggcaaatgtgaaaattgtatgtctggaaagtctaatttatgtctcgcgtatcccctgccattcagtggcctaatgcctgacggaacaagtcgtatgtccatcaatggtcaaaaactttaccatttcttttcctgcagtacttggtccgaatacattgtgattgattcaaattacgttgttaagttggatccgaggatatcccattcccacgcgtcatttattagctgtgggttttccactggttttggcgctacctggaaggaagttaatgttgaaaaaggaagctccgtagctgtctttggtttgggagcagtcggcttaggcgtagtcgagggtgcaagaatgcaaggggcttctaaaattatcggtgtagatattaatgagaagaaacgtgtgaagggacaggtctttgggttaactgattttattaatccatcaggttcagataaaagtataagcgatttgattaaagatttaactggtggtacgggtgtggactactgtttcgagtgtactggggttgctaccctagttaacgaagcacttgaagcaacaaaggtgggtattggtacttccgtcttaattggtgcaggtcttcaacagagcggtatgattaattttgttccattactctgtggccgtactttgaagggttccatttatggtggagtaaaaattcaatctgatctaccaattatattcgagaaatgtataaataaagagattaacttggatgaactattaactcatgaagtatcactggatgaaattaataaagcttttcagttattaaagcagcctgattgcgtaaaagtgctaattaaaata

SEQ ID NO: 1123 - DNA, 1131 bp, Sesamum indicum
atgacggatggaaccacaacgccaccagtgattacatgcaaagccgcggtgttacgcaaatctggtgaacctttgcaagtcgaagagattcaggtagacccacccaaatccactgaggttcgcattaagatgctttgtgcatcaatgtgtcacaccgatattctatgctgtaatgggttacccgtgccattatttcctagaatacccggccacgaaggagtgggcgttgttgaaagtgtcggtgatcaagtaacacacgtcaaggttggtgatacagttatgccactctacttgggcgaatgcggcgagtgcttgaattgttcaagtgggcgtactaatttatgccataaatatccgttgggcttttctggactaatggccgacggtacgtctagaatgtctgttggaggcgaaaaaatttatcatcatttttcatgttcaacatggtcagagtacgtcgtgatcgaagcaaattatgctgttaaagtcgacccaagagtctctctaccacatgcaagcttcttatgttgcggattcactactgggtttggaagcacatggagagaggttaatattgagaagggatctactgttgctgttataggcctaggggctgttggtttaggagctgttaaaggtgcccagatgttaggggcttctaaagttattggtatcgatattaacgaacttaagcatgaaaaggccaaagcgttcggaataactgaattcattaacccaaagctatcggacaaatctgtatcagaattgatcaaagaagctacgggtggcttaggggttgactactgctttgaatgcacaggcgttcctgctctgttaaacgaagctatagaaggatctaaggtcggtctaggcactattgtttttataggtgcgggattagaaaaatctggggagttgaattatattcccttattatgtggtagaactgttcgtggatcaatatatggcggggtaaggacgcaaagcgacttacctaaaattgttgagaagtgtgttaacaaggaaatagatttggatcaattgattacccacgaagtatcattggccgaaattaataaagggttcgagtacatgaaacagccagattctttgaaagttgtcatcaagttc

SEQ ID NO: 1124 - DNA, 1125 bp, Swertia japonica
atgaccatatcatcccccgctgttgttacttgcaaggccgctgtgatatggaagtctggagaaccagcgaaggtggaagaaatacaagttgatccaccaaaagctggtgaaattcgtgtaaagatgctttatgcttccctatgccatacagacgttttgtgctgcaatggtttacctgttcctttgtttccgagaattccgggtcacgaaggagttggtaccgttgaaagtattggtgagaacgttactaatgtgaaagagggggatattgttatgccattatatttaggcgaatgtggtgaatgtcttaattgcaagtcgggccgtagcaatttatgtcataaatacccattgggattctccgggctgctattagatggtacatctagaatgtcaataaagggggaaacagtatatcaccatttttcgtgtagcacttggtcagaatatattgtaattgaagcagcttatgcatttaaagttgatccaaagatgagtttgccacatgcctctttcctgtgctgtggatttacgactggctttggcgctgcctggagggaggtatgcgtggaaaagggtagcacagtggcagttttgggtctaggcgctgtaggtcttggcgttgtcgaggcagcaagagttcaaggggctagcagaatcataggattggacataaatgacaaaaagcgtgaaaaaggcgaagctttcggtataactgagttcattaatcctactggaagcgaaaagtcggtttcacaacttattttagaagcgacaggaggtttaggtgtagactattgctacgaatgtacaggagttcccgcgttgttaaacgagagtatcgaggctagcaaagtcggtttgggcacagctgtcttaatcggtgcagggttcgagactagcggcgttattaacttcatccctctattgtgcggtagaacgttgaagggttcaatctacggtggaatcagacctaactccgatctacctgctatagtagataagtgcatttcgaaggaaattaatcttgacgaactgcttacacatgaagtaagtctgtccgaaattaataaggctttcgagtaccttaaagatccagattgtgttaaggtagtcattaaattt

SEQ ID NO: 1125 - DNA, 1125 bp, Ophiorrhiza pumila
atgaccaaacgttctccatctgttataacatgtaaagcagctgttatttggaaaagtggggaagcagctaaagttgaggagatccaagtagaacctcctaaatcctccgaggtcagaatcaaaatgttatgcgcttccctgtgccatacagatatactttgctgtaacgggttacccgttccgttgtttcctagaatccccggccacgaaggtgttggtatggttgaatcggtgggggaaaacgtcacgaatttgaaagaaggtgatatagtcatgcccctttatttaggtgaatgcggtgagtgtttaaattgtcaatccggtaaaactaatctgtgccataaatatcctctcggcttttcaggtttgctgcttgacggtacatcaagaatgtccataggtggtcaaactgtatatcatcacttctcttgctcgacatggagtgaatacattgtgatagaggcaccatatgcagttaagatcgatcctagattatcacttccccatgctagttttctttgttgtggtttcactactggttttggcgcgacatggagagaagtgaacgtagtgaaagggtctacagttgcagttcttgggttgggcgctgttggcttaggtgttgtcgaaggtgcccgaatgcaaggcgcgagtagaatcatcggtatcgatatcaatgacatgaaaagagaaaagggagaagcgtttggaatgacagaattcataaaccctaaacacagtgaaaagtctatctctgaattgataaaagatgtcaccggtggactcggtgtagattattgttacgaatgcactggtgtaccagccctgctaaatgaggccatcgatgcatctaaggtcggtttgggtacagcagtgttgataggcgcaggacttgagacttcagggcaaattaactatattccattgttatgtgggagagttttaaagggctccatttacggtggagtcagaccattatccgatctacctacaattattgataaatgcattaacaaagaaataccacttgatgaacttatgactcatgaagtgtctctggatgagatcaataaaggttttgaatacttgaaacaacctgattgtgtaaaagttgtcataaagttc

SEQ ID NO: 1126 - DNA, 1125 bp, Cinchona ledgeriana
atgactaagtcttcacagggcgtcatcacttgtaaagccgccgttatttggaagagtggagagccaccgaaggttgaagagattcaggtcgatcctccaaaggcttctgaagtaagaattaagatgctatgtgcttctttgtgtcacaccgatatcttatgttgtaatggtttaccagttccactgtttcccaggattccaggccacgaaggggtaggtatggttgaaagcgtaggagagaatgttaccaatttaaaggaaggtgacattgtcatgcctctttacctgggagaatgtggcgaatgtttgaattgtaaatcgggtcgctcaaacttatgccataaatacccgctaggtttcagcggattattattggacgggacttctagaatgtcaacaggtggacagacaatctatcaccatttctcttgctctacctggtctgaatacatagttatcgaagctgcttatgctgctaaagtagatccaagaatttcatttcctcatgccagctttttgtgttgtggctttacgacagggttcggagctacctggagagaagtgacggtggaaaaggggagcactgttgccgtcttgggactaggtgctgttggtttgggagctgttgccggggcgcgaactcaaggtgcaactaggataataggtgtcgacataaacgatatgaaaagagaaaagggtgaagcttttggcataaccgagtttatcaacccaaaggattcggataaatcaatttctgaactaataaaagatgctacgggcggattaggcgtggattactgttacgaatgcacaggtgttcccgcgttattgaacgaagcaattgatgcaagtaaggtgggtttgggtaccatagtgttgattggagcgggtttaaagacgtctggcgaaatcaactatatcccacttttatgtgggcgaactctaaaaggttctatctatggcggtgttcgtccgcagtctgatttaccgagcattgtcgataagtgtattaataaggaaatacaacttgatgaattgattacccatgaggtaagcttacacgaaattaaccgtggttttgagtatttgaaacaacccgactgtgtgaaggtggtaattaaattc

SEQ ID NO: 1127 - DNA, 1134 bp, Lonicera japonica
atgactaaatcctctagcgaagttattacatgtaaagctgcagttatctggaagtcaggtgaaccagccaaggtggaggaaataaaggtagaccctcctaagtcctctgaggtcagaattaaaatgttgtgtgccagtctatgtcataccgatatcttatgttgtaacgggctcccggtgccccttttccccagaattccaggtcacgaaggtgtgggtatggttgaatcagttggtgaaaaggtaacagacgtaaaagaaggagatatcgtaatgcctctttaccttggggaatgcggagagtgtctcaactgcaaatccgaaaaaactaacctgtgccataagtacccattggatttcagtggggtcctgccatcagatggcacttcccggatgtcaattgcaaaatctggggagaaaatttttcatcatttctcttgcagtacttggagtgaatatgttgttatagaatcatcctacgtggtaaaggttgatcctagactccctttggctcatgcgtcattcctggcctgtggattcacaaccgggttcggagctgcatggagagaagctaacgtacacaagggtagcacagttgctgttttaggcttaggcgctgttggtctcggagtggtctctggggctaaggtgcaaggtgcatctaaaattatcgctgttgacataaacgacatgaaacgtgaaaaaggagagtctttcggcatgacagactttctcaatcctaaggaatccggtaaatcagcctctgaactaattaaagaggctaccggaggtttaggtgttgactattgctttgaatgcactggtgttccagccatgttaaacgaagccattgacgcaagtaaggtgggtttgggtacgattgttttaattggtgcaggaatggaaacgagtggcgttattaattacattcctttgctttgcggcagaaccttgaaaggtagtatatatggaggtgtaaggatccagtcggatttaccggttataattgaaaaatgtattaataaggaaattcaattagacgaacttcaaacccatgaagtatccttggaagaaattaatgaggcctttggacttttgaaacatccagactgtgttaaagtggttattaaattc

SEQ ID NO: 1128 - DNA, 1125 bp, Coffea canephora
atgaccaaaagtacgccatctgtcgtcacctgcaaggccgccgtggtttggaaatcgggtgagcccccaaaaatcgaagagatccaagttgaccctccaaaagcatcggaagtgcgcgtcaaaatgttgctggcctccttatgtcacacagacatattatgttgtcacggtttacctgtacctttattcccgagaatcccaggtcatgagggagttggaatggttgaatcagttggcgaaaacgttactaatttgaaagagggggatattgtaatgcctttgtatcttgctgaatgcggcgagtgcctaaactgcataagtggcaaaaccaacctgtgccataaatatcccctgggtttcagcggattgttattagacggaacttctagaatgtctatcagaggacaagccatctatcatcatttttcatgctctacatggtcagaatacattgtcatcgaggcaccatacgccgtgaaggttgacccaagagtttcattaccacatgcttcctttttatgctgcggttttacaacgggtttcggtgccgcctggagagaaatcacggttgaaaaagggtctacggttgcagttttaggattgggcgctgtaggtctgggtgtggcagggggtgcacgaatgcaaggtgcgtctaggataattggtgttgatagaaacgaaatgaaaagggagaaaggtgaggctttcgggatgacagagtttataaatcccaaaggttcagataagtcaatttctgacttgattaaggaagttacgggtgggctaggagttgactactgttttgagtgcactggggtaccagatttactgaacgaagccattgaggcatctaaaataggtttgggtacgtcggtgctaattggtgccggttttgaaacttccggtgattttaagtatattccattaatttgtggcaggactcttaaaggttcaatctatggcggtgttagaccaaaaagtgacctcccactgttattagaaaaatgtgccaacaaggagatccccttggatgaactaatcacccatgaagtaacgttggacgaaataaaccgtggattcgagtacctcaaacacccggattgtgtcaaagttgttgtaaaattc

SEQ ID NO: 1129 - DNA, 1125 bp, Rauvolfia serpentina
atgactaaatcgacaccaactgttattacttgtaaggcagctgtactatggaaggcaggtgaaccacctaagatcgccgagattcaagtagacccaccgaaggctccagaagttagggtgaaaatgctatgtgcctcattatgtcatacagattttttgtgctgtaacggtttgcctgtgcctttatttcctaggatcccaggccacgaaggtgttggaatgatcgaaagtgtgggagaaaacgttagagacttaaaggagggcgatatagttatgccgctttatctgggtgaatgtggggagtgcttgaactgtaaatctggtaggagtaatctttgtcacaaatatccattagggttttctggtcttttattagatggtacttcaagaatgtccatcggtgggcagaaagtttatcatcactttagctgttccacctggtccgagtatatcgtgacagaagctgcatatgctgtgaaggtggatcctagagtctctttgcctcatgcctcctttttatgttgtggtttcacaacaggctttggtgccacgtggagagagatcaacgtagaaaagggatcaactgttgcagtattgggattaggagcagttggtctgggcgcggtacaaggcgcaagaagccagggagcctcaagaattattggagtggatattaatgataaaaagagaaagaagggtgaagcgtttggcattaccgaattcataaatccgaaggggtcgaataaatctgtatcgcagttgatcaaagacgctactggtggattaggtgttgactatgtctatgaatgcacaggtgtgccggctctactaaacgaagctatagaggcgagtaaagtaggtctgggcacctcagttttgataggtgccgggctagagacaagtggagagataaagtttatcccattactttgcggtagaacagtgaagggtagcatatatggtggtgttaggccgaagtccgaccttcctaccattattgataaatgcataaacaaagagattcctatggacgagttattgacccacgaagtctccttgagtgaaattaataaagcttttgaatacttgaagcaaccagattgcgtcaaggtggtaattaaattt

SEQ ID NO: 1130 - DNA, 1128 bp, Gentiana rigescens
atgaccaagacaattaccccggctgtgattacttgtaaggcagcagttatctggaagtctggtgaacctgcaaaggtcgaagaaatacaagtagaaccacctaagactggagaggtcagagttcaaatgctgtatgcatccctgtgccatactgatgtattgtgttgtaacgggctgccagttccactttttccaagaattccaggtcacgaaggtgttggtgttgtagaatcagtaggggagaacgttaccaatttgaaggagggtgacattgtcatgccactttatttgggagagtgcggtgaatgtctaaattgtaaatcaggtaaatccaacctatgccataagtatcctcttggcttcagtggtttgcttctcgatggtacctccagaatgtcaataaagggtcaaactgtctaccatcacttttcttgtagtacttggagcgaatatatagtcattgaagctgcttacgctttcaaagtggatccaaagatttcgttgccacatgctagttttttgtgttgcggttttaccactggattcggtgctgcttggagagaagttgtaatagaaaagggtagcacagtcgcagttttaggattaggggcggtcgggttgggagttgtggaagctgcccggattcaaggagcaagtagaatcatcggtttagacataaacgataaaaagagagaaaagggtgaagcctttggattgaccgagtttatcaatccaagcgggtcagacaagtctgtctctcaacttattaatggcgtcacaggtggattaggtgttgattactgttatgagtgcacgggtgtccctgctttgttaaacgaagcaatagagagctctaaagtgggtctaggtacagttgttctaattggtgctggtttcgaaactagtggtaccattaatttcataccattgttatgtggtagaaccgttaaaggttctatatacggtggtgttaggccaaattctgatttacccgcaattatcgctaaatgtgtgaataaggaaattaatttagacgaattgctgactcatgaggtggcattaagcgatatcaataaaggttttgagtaccttcatgacccagactgcgtgaaggtggttataaaattc

SEQ ID NO: 1131 - DNA, 1134 bp, Catharanthus roseus
atgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaattt

SEQ ID NO: 1132 - DNA, 1128 bp, Nepeta cataria
atggctgacaacaccaacccgggagttatcacctgtaaggctgcagtcgcatggaagcctcttgagccactcaaggtggaggagatccaaattcagcctcctaagcccactgaagttcgcattaagatgctgtacgcttctatctgtcacacagacaccgtctgttggaccggcatcctttacgacatgttcccgagggtcttgggtcacgaaggtgtcggcgttattgagtctgtaggtgaagaggtaaccgacctaaaggttggtgataccgtgatgcctctctacgttggagagtgtggcaaatgtccaaactgtgcatccggaaagtccaacttctgttccaactaccccctgacactgggcctcatggccgacggcaccacgcgaatgtccgccaaaggtcagcagttgtaccagctattttcttgttccacctggtctgaatatgcagtgattgagtccaactacgtggtcaaggttgatcccaagcttagcctgagtggtgcatctctgcttacctgtggattcactacagggtatggcgccgtctggaaggtcgtcaacttcgagaagggctctaccgtggctgtcgtaggtcttggagcagtcggtttcggtgctgttaaggcggctcagatcctgggcgccagcaagattatcggtgttgatatcaacgagaccagacgagacaaagctaaggccctcggagtgaccgactttattaatccaaagagttctgacaagacaatgtcccagttgattcaggaggctactggcggcctgggagtggactgttgtattgagtgtactggcgtgccttctctgttaaatgaggcaatcgcttctacaaaggtcggttctggagaagtggtccttatttctgcaggagatgaacagaacaccgagctcaactatgttccccttctcctcggtcggaccgttaaagggactatttacggcggagttcgaattcattccgacctccacaagatagtggacaagtgtatctcaaaggagatagatttggacgagattataacccatgaagtctcgttggctgatgtcaacaagggtttcctcgagtacatgaagcaacccgactgcgtcaaggtgatcatcaagttt

SEQ ID NO: 1133 - DNA, 1128 bp, Ocimum basilicum
atggcgaacaatacgaacgccggcgtcatcacctgtaaagctgcagcagcatggaaaccatcggagcccctggtggtcgaggagatctgcgtggaaccccccaagtcaaccgaggtgcgaattaagatgctagcagcatccatgtgtcataccgacattcttctctggaagggattcttccccctgtaccctcgaatcccaggacacgagggcgcgggcgtcatcgaatccgtgggagagaaggttgcgaacctcaaggtgggtgatacggtcatgcccttgagcattgggcagtgtggcgagtgctccaactgtgctactggcaaaacaaacatttgcttcaaatacccattcggcattagcggactgatgcctgacggaacttcacgtatgtctgccaaaggtcagaaattgtaccatatgttcacctgctctacctggtctgagtacactgtcgtcgacagcaacttcgtggtaaaggtggatccccgaattcccttgccccacgcgtccctcctaacgtgtggatttctcacaggatatggagctccctggcgtgaatccagagtggagaagggtagcactgtcgccgttatcggattgggtgctgtgggtctcggcgccgtgtctgctagccgtattctaggagcctcgaagattatcggaattgacgtgaatgagcttaagcgagagaaggccactgttttcggcgtaacggagttcattaacccgaagcactcggataagactgtctcccagctcatccaggaggcaactggaggtttgggtgtggattgttgtatcgagtgtactggagtctcgtcgctgctaaacgaggccatcgcttcgaccaaggtaggcattggcgaggtggtcctcattggtgccggcgagaaggagaaggtcgaaatatcttacatcccactcatgcttggacgcagtgttaagggcaccacgctgggaggagtccgtatacactcggacttaccgaaaatcgtcgaaaagtgcattaacaaggagattgaccttgacgagctcattacgcatgaagtgagtctggtggacgtgaacaagggcttcatggagtatatgaaccagcccgactgtgttaaggtctcggtgaagttt

SEQ ID NO: 1134 - DNA, 1131 bp, Sesamum indicum
atggccaacaccagctccacttctcctgtcatcacatgtaaggctgccgtcattcgaaagccgggagagcctttgcaggttgaggaaatccaggtcgatcccccaaaacctactgaggtccgaattaaaatgctgtgtgcgtctatgtgccacaccgacatcctctgttgtaacggttttcccgcccccctgtttcccagaattcccggtcacgaaggtgtgggagtggtggagtctgtaggtgacgaagtaacccacgttaaggtcggtgacacagtgatgcccttgtatctcggcgagtgcggtgagtgccagaactgcagttctgggcgaaccaacctctgtcataagtatcctcttgatttcagcgggctaatggcggacggaacctcacgaatgtccgttggcggtgagaagatttaccacgtgttctcttgctctacttggtctgagtatattgtccttgagagttattacgccgtaaaagtggatccccgcctgtcacttccgcacgcttcgttcctgagctgcgggtttaccactggcttcggttcgacgtggcgagaagtcaatgtgaagaaagggtctaccgtagccgtcatcggcctaggcgctgtcggtctgggcgctgtcaagggcgctcagattcaaggcgcagccaagattattggcattgatattaacgagttaaaacaagagaaggccaaggctttcggcattacggagttcattaatcccaagctctctgaccggtctgtgtcggagctgatcaaagaggccactggcggactcggggttgattattgcatcgagtgcacaggcgttccagctctgcttaacgaggcgattgaaggaagcaaagtcggtctcgggactgtggtactaatcggagcaggactagagaagtccgtcgagctcaattacattcccctgctgtgtggccgcacggtccgaggctccatctacggcggcgttagagctcagagtgatctccccaagatcgtggagaaatgcgtaaacaaggagattgacctggaccacttgatcactcatgaggtctcgctggccgagattaacaaggctttcgagtacatgaagcatcccgactgcgtgaaagtcgttatcaaattc

SEQ ID NO: 1135 - DNA, 1131 bp, Capsicum annuum
atggagtcgtccaaccctaaagtgattacctgtaaggctgctgtcgcctggaaagagggcgagtctcttaagatggaggagattcaggtggatccacccaagtctagcgagattcggattaagatgttgttcgcgtccctctgccacacggatatattgtgtagcaacggcttccccgtccccctgtttccaagagtcctgggacacgagggtgtcggcatgattgaatcggtcggcgagaacgtcaccaagctgaaggaaggcgacatcgtgatgacactgtatctgggtgagtgtaacgagtgcccgaactgcaaatctggccgatccaacttgtgccataagtaccccatgcgattgagtggactcatgctggacggtacatcccggatgagcattcgaggagggcagatcctctatcatggtttgtcttgtagtacttggtcggagtacgccgtcatcaatgcgaattacgccgtaaaagttgacccccagcaggtcccccttccccacacctcgctgctatgctgcggatttaccactggatatggtgccgcttggagagaggtgtgtatcgagaagggttctactgtagcagtccttggcctgggggccgtcggacttggtgttgtggaaggggcacgatcgcaaggcgccggaaagatcatcggtgtggatattaataacttacgaagaggaaagggagaagcattcggcacgacagattttatcaatcccaaggaacacgaggcttctatcagtgatatgatcaagggaattaccggcggtcttggagttgattacgtattcgagtgtacaggcattccaagcatgttgaacgaagctattgaggcttccaagatgggtatcggcaccatcgtagtgatcggcgcgggcaatggaacatcacgagagttcaacctcataccccttatgtgcggccgcaccatgaagggcagcatttacggcggcatgcgcattcactctgaccttccagctctgctccaccgatgcgcgaacaaagaaatccagctggacgaactcatcacccaccaggtcagctttacagaaattaaccagctgttcgaattgctgaaggacccgcattgcctcaaaataatcatcaagttc

SEQ ID NO: 1136 - DNA, 1125 bp, Camptotheca acuminata
atgtccaagactagcagccaggtgataacctgtaaggcagcagtgtcttggggagcgggcctgcccctaaaagtcgaagaaattcaggttgagccccccaagtcatccgaggtccgactgaagatgttgtgcgcttctctgtgtcacacagatatcctttgctgcaacggactgcccgtaccactgttccctcgggtccccggccacgagggtgtgggcatggtcgagtctgtcggagaaggtatcaccggcctcaaggagggtgacatcgtgatgcccacctatattggtgagtgcgggaagtgcgagaactgtatgtccggcaagtccaacctgtgtttggcttaccccctgccgttttccggattgatgcctgatggaaccagccgaatgtcgattaatggacagaaattgtaccactttttttcctgctctacctggtccgaatatatcgtgatcgactccaattatgtcgtcaaactggacccccgtatctcccacagtcacgcttccttcattagttgtggcttttcaacaggcttcggcgctacctggaaggaggtcaacgtggagaagggctcttcggttgccgttttcggacttggcgccgtcggtctgggagtcgtcgagggagctcgcatgcagggcgctagtaagatcatcggcgtcgacatcaatgagaaaaaaagagtgaagggtcaggtgtttggcctgaccgattttattaatcccagcggatctgataagagcatatctgacctcattaaggacttgactggcggaactggagttgactactgttttgagtgcaccggagtcgccacccttgttaacgaggccctcgaggccacaaaggtgggaattggaacgtcggtcctgatcggcgccggcctgcagcagagcggtatgattaacttcgtccccctcctgtgtggacgcacactcaagggctccatttatggtggagtgaaaattcagtcggaccttcccattattttcgagaagtgtatcaacaaggaaatcaatctggacgagctcctaacccacgaggtgtctcttgacgaaattaacaaggcattccagttgctgaagcagcctgattgcgtgaaagttctcattaaaatt

SEQ ID NO: 1137 - DNA, 1152 bp, Solanum tuberosum
atgtcgccttccaagctcacgatggagtcctctaatcggaaggtgatcacgtgcaaggccgctgtcgtctggaaggagggtgaaatgattaaaatcgaggatattcaggtggatccaccaaagagcaacgaggttcgaattaaaatgctcttcgcctctctgtgccacaccgacatcttgacaacgaacggctttccttacccgcttttccccagagtactgggccacgaaggcgtgggaatgatcgagtctgtcggagagaacgtaaccaacctcaaggagggggacatcgtgatgcctctctatttgggtgagtgtaaggaatgcccaaactgcaagtctggaaagagtaacctgtgtcataagtaccaccttacattctctggccttatgttggacgatacttctcgaatgtctattcacggaggtcaagtgttgtaccactcgttctcttgctctacgtggtccgagtataccgttattaacgctaactacgtcataaaagtcgatcccaagaaaatccccctgcagcacgcctcccttctgtgttgtggatttacaaccggctatggcgcaacctggcgggaggtccacgtagagaagggttctacagtggcagtgctcggcctcggagtggttggattgggagctatcgaaggagcgagatcccagggagctagcaagatcatcggagtcgacatcaacgaatcgaaacgaggtaagggtgagctcttcggtatgactgacttcatcaaccccaaagagtctcgaacctctgttagtgagatgattaaggacgtgaccgagggtctgggcgtcgactacgttttcgaatgtaccggaatcccttctatgctaaacgaggcgatcgaggcatccaagcttggtatcggaaccatcgttgtcattggcgcgggacacggcctgacacgtgagttcaacctggtgccactcctttgcggacgaacccttaagggatccatttacggaggtatccgcctccattctgatctacccgctattctacaccgttgcgcgacgaaggaaattcagcttaacgatctcattacgcaccagatctcactgaccgagattaaccagtcttttgagctcctcaaggatccccactgtgtcaagatcatcattaagttt

SEQ ID NO: 1138 - DNA, 1131 bp, Sesamum indicum
atgaccgacggaaccactacgccccccgtgatcacttgcaaggccgcggttctgcgaaagtccggtgaaccactccaggtggaggagatccaagttgacccgccaaagtctacagaggtgcgaattaagatgctttgtgcttccatgtgccatacagacattctctgttgcaacggtctaccggttcccctgtttcccagaattcccggacatgagggtgttggtgtcgtcgagtcggtgggtgaccaggtgacccacgtcaaggtcggcgacactgtaatgccactgtatctgggtgagtgcggtgagtgccttaactgttcctctgggcgcactaacctctgtcataagtaccccctgggatttagcggcctgatggctgacggcacttcccgtatgagcgtgggcggagaaaagatctatcatcacttctcgtgctctacttggtcggagtatgtggtgattgaggccaactacgctgtaaaagttgaccctagagttagtctgcctcacgcttcttttctgtgctgtggtttcacaacaggattcggatccacttggagagaggttaacattgagaagggttcaacagtcgccgtgatcggactgggagctgtgggcctaggtgccgtcaagggtgctcagatgctcggtgcttctaaggttattggaatagacattaacgagctaaagcatgagaaggcgaaggctttcggtattacagagtttatcaaccccaaactgagtgacaaatctgtctccgagctcatcaaggaagccaccggaggactgggtgtggactactgtttcgagtgcaccggagtgccggccctgctgaacgaggcgattgagggctctaaagttggtctcggaaccattgtcttcatcggtgctggtctcgagaagtccggtgagttgaattacattcctcttctctgtggacgcaccgtgcgaggcagcatctatggcggtgtgagaacccagagcgaccttccgaagatcgttgagaagtgtgtgaacaaggaaatcgacctggatcagctcattacccacgaagtaagccttgctgagatcaataagggcttcgagtacatgaagcagcccgattccttgaaggtcgttatcaagttt

SEQ ID NO: 1139 - DNA, 1125 bp, Swertia japonica
atgactatctcatcgcctgctgttgtcacctgcaaggccgccgtgatttggaaatcaggtgagcccgcaaaagtcgaggaaattcaggttgatccccctaaggcgggggagatacgtgtgaagatgctctacgcttccctttgccacacagacgttctatgttgtaatgggctccctgtacccctattccccagaatacccggccacgagggtgtcggcaccgtcgagagcatcggtgagaacgtgaccaatgttaaggaaggtgacatcgtgatgcctctgtacctgggagagtgtggagaatgccttaactgtaagagcggtcgatctaacctgtgccataagtacccccttggtttttcgggactgctgctcgacggaactagccgtatgtctatcaagggcgagaccgtctaccaccacttctcatgttcaacctggtctgagtacattgtcattgaagctgcctacgcgttcaaggttgatcccaagatgtctctcccccacgcctcctttctgtgctgcggctttacgaccgggtttggagccgcttggcgagaggtatgtgttgaaaagggctcgactgtcgcggtcttgggcctgggcgcggtgggtctaggtgtcgtcgaggccgcacgagtgcaaggcgccagtcgtatcattggtctcgacatcaacgacaagaaacgtgagaagggcgaggccttcggaatcactgagttcatcaaccctaccggctcagaaaaatcggtgtctcagctcatcctggaggccaccgggggattgggggttgactactgctacgagtgtacaggtgtgcctgctctcctcaacgagtcgattgaggcatctaaggtcggactgggtaccgcagtgctcatcggtgcgggctttgagacgtctggtgtgataaattttatccccctgttgtgtggacgaactctgaagggctcgatttacggtggtatccggccgaactcggacctgccggctatagtggataagtgtatttccaaggaaattaacctggatgaactgctcacccacgaggtctcgttgtctgagattaacaaggccttcgagtacctgaaggatcccgactgtgttaaggtcgtaatcaagttc

SEQ ID NO: 1140 - DNA, 1125 bp, Ophiorrhiza pumila
atgaccaagcgatctccttctgtgattacctgtaaggccgctgtgatctggaaatccggagaggcggccaaggtggaggagattcaggtcgagccacctaagtcttctgaggttcgcattaagatgctgtgcgccagcttgtgtcataccgacattctctgttgtaacgggttgcccgtccccctttttcccagaattcccggacacgagggggtcggaatggtggaaagcgttggcgagaacgtcaccaatctgaaggagggagacatagtcatgcctctgtaccttggtgaatgtggagagtgtcttaactgccaatctggaaagaccaacctgtgccataagtacccgctcggattctccggtctgctcctggatggaacttcccggatgtccatcggtggccagaccgtctaccaccacttctcctgctcgacttggtcggagtacattgtgatcgaggctccatatgcggtgaagatcgacccgcgactgtctctgcctcacgcctcgttcctgtgttgtggatttactaccggattcggcgccacatggagagaggtcaacgtcgtgaagggcagtaccgttgctgtactcggattgggcgctgttggcctcggagtggtggaaggcgccagaatgcagggtgcaagtcgaatcattggcatcgacattaacgacatgaaacgagagaagggcgaagccttcggcatgaccgagttcattaaccctaaacattccgagaaatctatttccgagcttatcaaggacgtgactggaggtttgggtgtagattactgctacgagtgtactggtgtccctgccctccttaacgaagccatcgacgcctccaaggtgggcctgggcaccgccgtcctaatcggggcaggactcgagacctcgggacagattaactacattccgctgctgtgtggacgagtgcttaagggatcaatctatggtggcgtccgaccactctccgacctgccgaccatcatcgacaagtgtatcaataaggagatccccctcgatgagctgatgactcatgaagtctctctagacgagatcaataagggttttgaatacctgaagcagcccgattgtgtcaaggttgtcattaagttc

SEQ ID NO: 1141 - DNA, 1125 bp, Cinchona ledgeriana
atgaccaaatcttcgcagggagtcatcacatgtaaggctgccgttatctggaagtccggggagccccctaaagtcgaggagatccaagtcgatccgcccaaggcttccgaagttagaatcaagatgctgtgtgccagtctgtgccacactgacatcctctgctgcaatggcctccccgtaccactgttcccccgcatcccgggccacgagggcgtagggatggtagagagcgtcggcgagaacgttaccaacctgaaagagggcgacatcgtgatgcccctatacctgggcgagtgtggtgagtgcctgaactgcaagtctggccgatccaatctgtgtcacaagtaccccctcggattttctggcctcctgcttgatggcacctctcggatgtccactggtgggcagaccatttaccaccacttctcgtgcagcacctggtccgagtacattgtgattgaggccgcctatgctgcgaaagtggacccccgtatctcgttccctcacgcttcttttctgtgctgcggctttactacgggattcggcgcaacttggcgagaggtcaccgtcgagaagggatctaccgtagcggttctgggcctcggagccgttggcctgggcgccgtggccggcgccagaactcagggtgccacgcgaattattggggtcgatattaacgacatgaagcgagagaagggtgaggccttcggtattactgagttcatcaaccccaaggactccgacaagtcgatcagcgagcttattaaggatgcaactgggggcctgggcgtcgattactgttacgagtgtactggcgttcccgccctgttgaacgaggcaatcgatgcctccaaggtgggcctcggaaccattgtgcttatcggcgctggcctaaagaccagcggagagatcaattatatccctcttctctgcgggcgaaccctcaaaggcagtatctatggcggggttcgaccacagtcggatttgccctcgattgttgataagtgtattaacaaggagattcaactcgacgagctgatcacccacgaggtctctctccacgagattaatcgaggctttgagtatctcaagcagcctgactgcgttaaagtcgtcattaagttt

SEQ ID NO: 1142 - DNA, 1134 bp, Lonicera japonica
atgactaaatcttctagtgaggttatcacgtgcaaggccgctgtgatctggaaatcgggcgagcccgccaaagtcgaggagattaaggtggaccccccaaagtcgtctgaggtgcgtattaagatgctgtgtgcctcactgtgtcacaccgacatcttatgttgcaacggactccccgtccctttgttcccacggatcccgggtcacgaaggcgttggtatggttgagtcagttggcgagaaggttacggacgttaaggaaggggatatcgttatgccgttgtacctgggagagtgcggtgagtgtcttaactgtaagtctgagaagacaaatttgtgccacaagtatcccctggatttcagtggcgtgctgccctcagacggtacctctcgaatgtccattgctaagtcgggcgaaaaaatttttcatcatttttcttgtagcacttggtcagagtacgtcgtaatcgagagcagctacgttgttaaggtcgacccccgtctcccgcttgcccatgccagttttctggcgtgtggattcaccaccggatttggagccgcatggcgagaggccaacgtgcataaaggctcgactgtggccgtccttggactgggtgcagtggggttgggagtggtatctggagccaaggttcagggcgcctctaaaattattgctgtcgacattaacgatatgaagcgagagaagggcgaatcattcggtatgaccgacttccttaaccccaaggagagtggtaagagcgctagcgaactcattaaggaggccacgggcggtcttggtgtggattactgtttcgaatgcactggagttcccgccatgcttaatgaggctattgacgcttccaaggtcggcttgggtaccatcgtcctgatcggtgcgggaatggagacgtctggcgtgattaactatatccctctcctctgtggccgcaccctgaagggatccatctatggaggtgtccgaattcagtccgacctgccagtgatcattgagaaatgtatcaacaaggagattcagctcgacgaattgcagacgcatgaggtgtctctggaagagatcaacgaggcctttggattgcttaaacaccctgattgtgttaaggttgtcattaagttt

SEQ ID NO: 1143 - DNA, 1125 bp, Coffea canephora
atgaccaagtcgacgccctctgtagtgacctgcaaggccgctgtcgtgtggaagagcggcgaaccgcctaagattgaggagatccaggtcgaccccccaaaggcttcggaggtccgagtcaagatgctgctcgcctctctctgccacaccgacatcctctgctgccacggcctccccgtacccctctttccccggattcctggccacgagggtgtcggcatggtggagtctgttggagagaacgtcaccaacctgaaggagggtgacatcgtgatgcccctgtaccttgcagagtgcggcgagtgcctcaactgcatttcgggtaagaccaacctgtgccacaagtacccattgggattctctggcctgctccttgacggcacttcccgaatgtcgattagaggccaggctatttatcaccacttctcctgctccacgtggtccgaatatatcgttatcgaggccccctatgctgtgaaggtcgacccccgagtgagcctcccgcatgcctcctttctctgctgcggattcacgactggattcggtgcggcctggcgagaaatcacagtggagaagggaagtacagtcgcagtcctcggtctgggagctgtcggcctgggcgttgccggcggagcccgaatgcagggtgccagtaggattatcggcgtcgatcgaaatgagatgaagagagagaagggagaagcgttcggaatgacggaattcatcaaccccaagggctcggacaagtcgattagtgatctcataaaggaggtcaccggtggcctcggagttgactactgttttgagtgtactggagtgccagacctccttaatgaggccatcgaggcttctaagattggccttggaacatccgtcttgatcggcgccggcttcgagacctcaggagattttaagtacatcccactgatttgtggacgaaccctgaagggatctatctacggaggagttcgtccaaagtccgacctgccgctgctcctggaaaagtgtgcgaacaaggagatccctctagacgagctcatcacacacgaggtcacccttgacgagattaacagaggcttcgagtacctcaagcaccctgactgtgtgaaggttgtggttaagttt

SEQ ID NO: 1144 - DNA, 1125 bp, Rauvolfia serpentina
atgaccaagagcacacctactgttattacctgtaaagcggctgtcctgtggaaagcgggcgagcccccgaagatcgccgaaattcaagttgatccacccaaggcacctgaggtgcgagttaagatgctttgcgcatcgctctgccacaccgactttctgtgttgtaacggactcccagtgcccctgttcccacggatccctggacacgaaggagttggaatgatcgagagtgttggcgagaacgtgcgtgaccttaaggagggtgacattgtgatgcctctgtacctgggcgagtgcggagaatgtctgaattgcaagtcaggccgaagcaatctgtgccataagtatccccttggtttttccggtctcctcctggatggcacttcccgtatgtcaatcggaggacaaaaggtttaccaccatttctcctgtagtacttggtccgagtacatcgtgaccgaggccgcctacgcagtgaaggtggaccctcgagtatcgctaccgcacgcttcgtttctgtgttgtggatttaccactggattcggagccacttggagggagatcaacgtcgagaagggttcaactgtggctgtgctcggcctgggtgccgtgggcctcggcgccgtgcagggcgcccgttctcagggcgcttcccgaatcatcggagtagacattaacgacaagaagaggaagaagggtgaagcgttcggaattactgagttcatcaaccccaagggctctaacaagtcagtatcgcagcttatcaaggacgcgactggcggactgggcgtggattacgtctacgagtgcactggcgttcctgctctgctgaacgaggccatcgaagcttctaaggtgggacttggaacctccgtcctcattggcgccggcctggaaacttccggcgagatcaagttcattcctctgctgtgcggaaggactgttaaggggtcgatctacggcggggttagaccgaagtccgacctgcccaccattattgataagtgcatcaataaggagattcccatggacgagctgcttacacatgaggtctcgctgtcagagatcaacaaagctttcgagtacttgaagcagccagattgcgtgaaagtagtgatcaaattc

SEQ ID NO: 1145 - DNA, 1128 bp, Gentiana rigescens
atgaccaaaactatcacccctgccgtaatcacttgtaaggccgccgtcatctggaagagtggagagcccgccaaggttgaggaaatccaggtagaaccacccaaaaccggtgaggtgcgggttcaaatgttgtacgcctccctttgtcatactgacgtcctatgttgcaacggtctgcctgtccccctttttcctcgaatccctggacacgagggagtgggagtggttgaatctgtcggcgaaaacgtgaccaacctcaaggagggcgatatcgttatgcctctttacctcggtgaatgtggagaatgcctcaactgcaagtctggaaagtccaacctttgtcacaagtacccgctgggtttttcgggcttactgctcgacggtacctctcgaatgtctattaagggtcagaccgtttaccatcacttttcatgcagtacatggtcggagtacatcgtcattgaggctgcctacgcctttaaagtggaccccaagatctccctcccacacgcatcttttttgtgctgcggattcaccaccggctttggcgcagcttggcgtgaggtcgtcattgagaagggatcgactgtcgctgtcttgggacttggcgccgtcgggctcggtgtcgtggaggcagctcgaatccagggagcctcccgtattatcggcctcgatattaacgacaagaaacgggaaaagggggaggccttcggtctgaccgaattcattaatccaagcggctcagacaagtcagtgtcccaacttatcaacggagttaccggaggactaggtgtggattactgctacgagtgtaccggcgtgccagctctactcaacgaagctattgagtcatccaaagttggcctgggcactgtagtcctgatcggtgctggattcgagacctccggtaccataaacttcatccctctcctgtgtggacgaacggttaagggttcgatctacggaggtgtgcggccgaactcggacctgcctgcgattattgccaagtgtgtcaacaaggagattaacctcgacgagctactaacgcatgaagtcgctctttctgacattaacaagggcttcgagtacctacatgaccccgactgtgttaaagttgtcataaagttt

SEQ ID NO: 1146 - DNA, 1134 bp, Catharanthus roseus
atgaccaaaaccaacagccctgctccttccgttatcacgtgtaaagcagctgtggtgtggaaatccggtgagcctcccaaggtcgaagagatccaggtggaccctcccaaggcttcggaggtccggatcaagatgctgtgtgcttccctgtgtcacactgacttcttggcttgcaacggtcttcctgtgcctctgttcccacgaattcccggccacgaaggggtgggcatgattgagtctgtgggagagaacgtcactaatctcaaggagggagatatcgtcatgcccctttatcttggtgagtgcggagagtgcctgaattgtaagtcaggccgaaccaatctctgccataagtaccctctggggttctcaggcctgttgctcgacggcacctcaagaatgtccatcggggagcagaaggtgtatcatcacttttcctgttccacatggtcggagtacattgttatcgaggccgcttacgccgtgaaggtggatccacgcgtttctctgccccatgcttcgttcctttgttgcggatttaccaccggattcggagcgacatggcgagacgtgaacgtggttaaggggagtacagttgctgtgctgggtctgggcgcagttggactgggagccgttcagggcgctaaatcccagggagcctcgcgaatcatcggccttgacattaatgacaagaagcgagagaagggagaggccttcggtatgactgaattcatcaacccgaagggttcgaacaagtctatttccgagctcatcaatgaggccaccggcggattgggactcgactacgtgtacgagtgtacgggagtgcctgccctgctcaacgaggctatcgagtcgtccaaggtaggcctcgggacagccgtgctgatcggtgccggtcttgaaacgtccggggagattaaattcatccccctgctttgcggacggaccgttaagggttccatttatggcggagtgcgacctaagtcggatttgcccactctcatcgaaaagtgcatcaacaaggagatccctatggacgagcttatgacacacgaggtgagcttgtccgaaattaacaagggatttgagtacctgaaacaccccgattgtgtgaaggtggtgatcaaattt

SEQ ID NO: 1147 - DNA, 1125 bp, Olea europaea
atgactaaccggaacccagaagtcatcaagtgcaaggctgcagtcgtgtggaaggccggggagccgctgaaggtggaagagatccaggtggacccccctaaatcttcggaagttcgaatcaagatgctctgcgcatctctctgccacacggactttctgtgctgcaacgggcaccccgtccccctcttcccccgaatccctggacatgagggcgtaggcatgattgagtctgtaggcgggggcgttactaacctgaaggaaggagaccgagttatgcctctgtacctgggagagtgtggagaatgccttaactgcaagtctggaaaaaccaacctatgtcacaaatatccatttaactttacaggtcttatgccggacggcacctctcggatgcatattggcgaccaaatcatctaccaccatttctcctgtggcacctggtccgagtacgtggtcatcgacgctaactttgccgtcaaggtcgacccccgggttcctctggcgcacgcaagctttctctgttgcggattcaccaccggattcgggtctgcatggcgagccgttactatcgagaagggctctactgtagctgttatcggcgtgggcgccgttggactgggtgtgatggaggccgctcgaatgcaaggtgcttcacgaattattggaatcgacaagaacaactttaagaaaaagaagggcgaggcctttggaatgactgaatttatcaaccctaaggaatccgacaagccagtgtccgagcttattaaggacgcaacaaacggacttggtgtcgattacttctacgagtgtacaggcgtgcctgcacttctcaacgaggctatagagggctcgaaggtgggtctaggcacgattgtcttgattggatctggtctcgacctgtcaggagaactcaagtacatcccgcttctttgtggtcggaccctgaagggcagcacgtacggaggtgttagaccccagagcgacctcccaattattgtcgagaagtgtattaacaaagagattcagctggacgagctcgaaacccacgaagtttctcttgaggaaatcaacaaagcctgggagtacttaaagcaacccaactgcgtcaagattgtgatcaactac

SEQ ID NO: 1148 - DNA, 1134 bp, Sesamum indicum
atgacaaacactaacaccacccctgccgttatcacttgcaaggccgccgtgattcgtaagtcctgggaaccacttcaggttgaagagatccaagtggatccgccaaagtcaggcgaggttcgaattaagatgctgtgcgcctcaatgtgccataccgacatgacctgctgtaactcgggatttcccgtacccttctttccccgcatcccgggccatgaaggcgtgggagtcgtggaatccgtcggcgaacaggtgaccaacctgaaagtgggagatatcgtcatgactctgtatctcggcgagtgcggcgaatgtctcaactgttcttctggacgaaccaacctttgccacaagtaccccctaggcttcgatggattgatgcccgatggaacttctcgactatctgtcggtggggagcgaacttaccacctggtcagctgttctacctggtcagaatatgctgtcatcgacgccaactacaccgtcaaggtggacccacgtctgagtccacctcacgccagcttcctgtgctgcgggttcaccaccggattcggatcttcttggcgggaggtgaatatagagaagggatccacggtggctgtgattgggcttggtgccgttggattgggtgccgccaagggtgcgcagttgcaaggagcatcgaagatcatcggaatcgacattaacgagcttaagaaggaaaaggccaaggccttcggaatcactgattttattaatccaaaactctcagacaaaagcgtgagtgagctcatcaaagaagctaccggcggactcggagtcgattactgtttcgaatgttctggcgttcccgctctcgtgaacgaggcaatcgaaggatcaaagatgggcctgggtacgattatggtcttaggcgtaggccctggcaagtccgtggaggtcgattacatcccactgctctgcggccgaaccctgcgaggctcaacttacggcggcgtcagaacccagtccgacttgccgaaaatcatcgagaaatgcgtgaacaaggagattgacttagaccagctgattactcacgaagtgtctctcgccgagatcaataagggccttgagtacatgaaacagccaaattgtgtgaaggttgttattaaattc

SEQ ID NO: 1149 - DNA, 1125 bp, Olea europaea
atgactcgaggaaaccccggtgtgatcacgtgcaaggcagccgttgtgtggaagtccggtgatcctttgaagattgaggagatccaagttgatccgcctaagacctcagaagtgcgaatcaagatgctgtgtgccagcctttgtcacaccgacttcctctgcaggaacggcctgcccgtccccctcttccctcgcattcccggtcatgaaggtgtggggatgattgagtcggtcggagaggggatcacgaaccttaaggagggagacgtggtcatgcccctgtacctcggtgagtgcggtgagtgcctgaactgcaaatccggcaagactaacctctgccacaagtacccccttaactttactggtctgatgccggatggaacttctcgaatgcatattggggaccagattatttatcaccacttctcttgtggcacgtggtctgaatacgtcgttatcgatgccaactttgctgtgaaagtggatcctagagtttctctagctcacgcctcgttcctatgctgcggtttcactaccggattcggaagtgcctggcgagaggttaccatcgaaaagggctccactgtcgccgtgatcggagtcggtgcagtgggactgggtgtcatcgaggctgcccgtatgaacggggcttctaggatcatcggtattgacatcaataacttgaagaaaaaaaaaggcgaggtttttggcatgacagagtttatcaatcccaaggagtccgataagcccgtttctgagttgattaaagaaaccactgggggacttggtgttgattattgttacgaatgtactggcgttgctgagctgctgaacgaagccatcgaaggctctaaggtcggcctcggtaccattgtgttcattggagcgggccttcacctgtccggcgaactcaagtatattcccctcctctgcggtcgaactattaagggatcgatttacggcggcgtgcgcccgcagactgacctgcccaaaattgttgaaaagtgcattaacaaggagattcaactggacgaactgcttacgcacgaggtgagtctggaggaaatcaataaagcttgggagtatctgaagcagccctcgtgtgttaaggttgttattaagtac

SEQ ID NO: 1150 - DNA, 1152 bp, Erythranthe guttata
atgacctcacggggcgttatgacctgtcgggccgcagtcgtccggaagtgcagagaagccctggaggtggaggaaatcgaggtagatccacccaagtcctctgaagtgcgaattaaaatgttgtgcgcctcaatctgtcacaccgatatcttgtgctggcagggcgtcccacttgttctgtctaccatgaacacgcttataacttcaccgatgttcccccgaattcccggacacgagggagtgggtgtgattgagtccgtgggagagaacgtaaccaacctgaaggtcggggacaccgtcatgcccttgtaccttggcgagtgtggcgagtgctctaactgcatttcgggtattaccaacctgtgtcataagtaccctttcaacttcaacggcctgatggccgatggtacaagccgcatgtcggttaagggcgagcggctttaccaccacttctcgtgctcgacgtggtcggagtacgccgtgattgatgcaaactacgcggtcaaggttgatcctcgaatctcccttcctcacgcttctttcctatgctgcggcttcaccactggctttggatccaccagccgcgtggtcaatattcacaagggctcgaccgtggctgtgattggtctgggtgccgtcggactcggagccgtgaagggagctcagatgcttggcgcttctaagatcattggcatcgacattaacgagaagaaacacgacaaggcgcgatttttcggaataaccgagttcattaacccggaggtgtctggaaagagcgttagcgagctgattaaggaggcgactggcgagctgggcgtagattactgtttcgagtgcaccggcgttccagctctcctgaacgaagccattgagggctcgaaggtgggcaccggaaccgttgtctttattggagccggtgtcgagaagtctggagaacttaactacatccctctgctgtgcggtcgaactgtgaagggatctatttacggaggcgtgcgtacacacaccgacttaccttccattgtggacaagtgtgtgaataaggagattgacctggaccagctcattacccacgagatttccctggctgagatcaacaaaggcttccaatacatgaaggatcctaactgtatcaaagtagtgatcaaattt

SEQ ID NO: 1151 - DNA, 1080 bp, Catharanthus roseus
atggcaaaatcaccagaagtggaacatccagtcaaagcgtttggttgggcagccagagatacgagtggtcatttaagtccatttcatttttctagaagagccacaggtgagcacgatgttcaatttaaggttttatactgtggaatctgccattccgaccttcacatgattaagaatgaatggggattcaccaaatacccaatagttcctggtcatgaaatcgtcggtatcgtaactgaagtaggctcaaaagttgaaaaatttaaagtaggtgataaagtgggagtaggctgtttggtgggatcatgtcgtaaatgtgatatgtgcacaaaggatttagaaaactattgccctggacagatactgacttatagtgctacgtatacagatggtaccactacgtatggtgggtactctgacttgatggttgcagacgagcattttgtgataagatggccagagaatcttccaatggatatcggagccccgctattgtgtgctggtattaccacttactcacctcttcgatatttcggattagataaacctggtactcatgtgggtgttgtgggcttaggtggcctgggacacgttgctgttaaatttgctaaagccttcggtgcaaaagttacagtgatcagcacttcggaatctaagaaacaggaagcattggagaaattaggagcagattcttttttggtttccagggatccagaacagatgaaagcagctgctgcgtctttggacggaataatagataccgtttctgctattcacccaatcatgccgctattgtccatccttaaatctcatgggaaattaattcttgttggtgcgcctgaaaagcctttggaattaccctcctttcctctgattgctgggaggaagattatcgctggttcagcaattggtggattgaaggagacacaagaaatgatcgattttgcagctaagcataacgtgttaccggatgtggagctagtttctatggattacgtgaacacggcaatggaaagattattgaaggctgacgtaaagtatcgttttgtcatagatgtcgcaaataccttgaaaagtgca

SEQ ID NO: 1152 - DNA, 1128 bp, Ocimum basilicum
atggcaaacaacactaacgctggcgtcataacctgcaaggcggctgccgcttggaagccctcggaaccgttagtagttgaagaaatttgcgtggaacccccaaaatccactgaagtgaggattaaaatgttagctgcgagtatgtgtcatacggacatactattatggaagggtttctttcctctttacccacgtattccgggtcacgagggtgctggtgtgattgaaagcgttggtgaaaaggttgctaacctgaaagttggagacacagttatgcccctgtcaatcggtcaatgcggtgaatgttctaactgtgcaactggtaagaccaatatctgttttaaatatccatttggtatctctggtttgatgcccgatgggacatcaaggatgagcgctaagggccaaaaactgtatcatatgtttacgtgcagcacttggtcggaatacactgtcgttgacagcaatttcgtggttaaagtagaccctaggatcccattacctcacgcctcactgttaacctgcggttttttaacaggatacggtgctccttggcgcgaatcacgtgtagaaaagggcagtacagttgccgtgattggtttgggggctgtaggtttaggagcagtttcagcatctagaatattaggtgctagtaagattatcggtatagatgttaacgaactcaagagggagaaagcaactgtgtttggtgtaacggaatttatcaacccaaagcactctgacaagacagtgtctcaactaattcaagaagcaacgggtggtctgggtgttgattgttgtattgaatgtacgggtgtttcgagccttttgaacgaagctatcgcttccacaaaagtagggatcggtgaggtagtactgattggggctggcgaaaaagaaaaggttgagatctcttacattccacttatgctcggtaggtctgttaaaggaactacactgggtggtgtaaggatccacagcgatttacccaaaatagtggaaaaatgcataaacaaagaaatcgatctggatgaattaatcacgcatgaagtgtctttggtagatgtgaataaagggtttatggaatatatgaaccaacctgactgtgtcaaagtgtcggtcaaattc

SEQ ID NO: 1153 - DNA, 1125 bp, Camptotheca acuminata
atgtcaaagacatcatcacaggttatcacgtgcaaagctgctgttagttggggtgctggattaccattgaaagttgaagaaattcaagtcgaacctccgaaaagttccgaagtcagattgaaaatgttgtgcgccagtctctgtcacactgatattctttgctgtaacggtttgcctgtcccgttgtttccgagagttcccggtcacgagggcgttggtatggttgagagtgtgggtgaggggattacgggcttaaaagaaggtgatattgtcatgccaacttatattggtgagtgtggtaagtgtgaaaattgtatgagtggtaagtctaacctttgtcttgcttacccattgccattttcaggtctaatgcccgatggtacatctaggatgagtataaatgggcaaaagctatatcatttcttctcttgttcaacttggtctgaatacattgttatagattctaattatgtcgtgaaattggaccccagaatttcccatagccatgcctcattcatttcatgtgggttctctactggtttcggtgctacatggaaagaggttaatgtagaaaaaggctctagtgtcgctgtttttggtctaggggctgttggcttgggtgttgtcgaaggagctagaatgcaaggtgcctcaaaaatcattggagttgacataaatgaaaaaaaaagagtcaaaggacaagtctttgggctcaccgatttcattaatccctctggttcagacaagagtatcagcgacctaataaaagacttaacaggtggaactggcgtcgactattgcttcgagtgtactggagtcgccactctcgtaaacgaagctcttgaagctaccaaggttgggataggtacctctgttcttatcggcgctgggttacaacagtcaggtatgattaatttcgtacctcttttgtgtggtagaacactcaaaggatcaatatacggtggtgttaagatccaatctgatctacctattatttttgagaaatgcataaataaggaaattaatctcgacgaattgttaacgcatgaagtgtctttagacgagataaataaagcctttcaactacttaaacagcctgattgtgttaaagtgcttatcaagatc

SEQ ID NO: 1154 - DNA, 1125 bp, Swertia japonica
atgacaattagttcccccgctgttgtcacatgtaaagcagcagtgatctggaagtcaggtgaacctgcaaaagtcgaagaaattcaagttgatccaccaaaagctggggagatcagggttaaaatgttgtacgcatccttgtgtcatactgatgttttatgttgtaatgggctcccggttccattgtttcccagaatacccggccatgaaggagtcggtactgtcgaatcgataggtgagaacgttactaacgttaaggaaggtgatatcgttatgccgctgtaccttggagagtgtggtgaatgtcttaattgtaaatcgggtaggtctaacctgtgtcacaagtatccattgggattttctggtttactgctggacggcacatcgagaatgagtataaaaggtgaaaccgtttatcatcatttttcatgtagcacctggtcagagtacatcgtgatagaggcggcatacgcctttaaagttgatcctaaaatgtcattaccccacgccagctttttgtgttgtggtttcaccacgggatttggcgcagcttggagagaggtgtgtgtcgaaaaaggatccactgtagctgtcttaggactaggggcagttggtttgggcgttgtggaagcagctcgagtccaaggcgcttctagaattattgggttggatattaatgacaaaaagagggaaaagggagaggcttttggtatcactgaatttattaatccaacaggctctgagaaaagtgtgagccaattaattctggaggctactggagggttgggcgtagattactgctacgaatgtacaggcgttcctgctctgcttaatgagtctattgaagctagtaaggttggactcggtacggccgttttgattggtgcaggcttcgaaacgtctggtgtcattaatttcattccattattatgcggtagaactctaaagggttcaatttacggcggaataaggccaaactcagatctaccagccatagtggacaaatgtatctcaaaggagatcaacctagatgagctcctaactcatgaagtgagtttaagtgaaataaacaaagcctttgaatacttgaaggacccagattgtgtgaaagttgtcataaagttc

SEQ ID NO: 1155 - DNA, 1125 bp, Cinchona ledgeriana
atgaccaaaagtagccaaggtgtgattacttgtaaggctgcagtcatctggaagtcaggtgaacctcctaaggtagaagaaatccaggttgacccgccaaaagcatcggaagtgagaattaaaatgctatgtgcatccctatgtcataccgatatcttgtgttgtaatggtttaccggttcccctatttcctaggataccaggccacgaaggagttggcatggtcgaaagcgttggcgaaaacgtaacaaatttgaaagaaggcgatatcgtaatgcccctttacttaggcgaatgcggtgagtgcttgaattgtaagagcggtcgttcaaatctctgtcataagtacccattgggtttcagcggattgttattggatggtacgagtagaatgagtactggcggtcaaaccatttatcatcatttctcttgctctacttggtcagaatacattgttattgaggccgcatatgcggcaaaagttgatccaagaatctctttccctcatgcttcattcctgtgttgcggtttcactacaggtttcggtgctacttggagggaggttacggtagaaaaaggaagcacagtcgcggttttgggtttgggagctgttggtcttggtgcggtggcaggtgccaggacccaaggagctaccaggattattggtgttgatattaatgatatgaaaagggaaaaaggagaagcatttgggataactgagttcattaatccaaaagactccgacaaatccataagtgaattaataaaagatgctaccggcggtcttggtgtagactactgctacgaatgcaccggtgttccagcattgctaaatgaagctattgatgctagtaaagtgggtcttggtacaattgttttgattggagctggacttaaaacctcaggcgagatcaattatatacctcttttatgtggtcggaccctaaagggtagcatttatggcggtgtcaggccacaatctgatctacctagtattgtagataagtgtattaacaaagagatacaactagatgaacttataacccatgaagtgtctttgcatgaaattaatcgaggctttgaatatcttaaacaacccgattgtgttaaagttgttattaagttt

SEQ ID NO: 1156 - DNA, 1125 bp, Rauvolfia serpentina
atgaccaaatctactccgaccgtaatcacctgtaaagccgctgttctatggaaggccggtgaaccacccaagatcgctgaaatccaagttgatccaccaaaagcaccagaagttagagtaaaaatgttatgtgcatccctgtgccacaccgactttttgtgttgtaacggtcttcccgttccgttattcccacgaatccctggtcacgaaggggttggtatgattgaatccgttggagaaaacgtcagagatcttaaggagggagatattgttatgccactatacctcggtgaatgtggtgaatgtttgaactgtaagagcggccgttcgaacctatgtcataagtaccctctaggattctctggattacttcttgatggtacttccagaatgagcatcggtggacagaaagtgtatcatcattttagctgctcaacatggagtgaatatatcgtaactgaggctgcatacgcagtaaaagttgaccctagagtttctttgccccacgcatcatttctttgttgtggttttacaacgggctttggcgctacttggagagagattaatgtcgaaaaaggttcgactgtcgcagtcctaggcttaggtgctgtgggattaggtgcagtgcagggtgcgagatcgcaaggagctagcaggattattggtgtggatattaacgataagaaaaggaaaaagggtgaagccttcggcatcacagaattcattaatcctaagggaagtaacaagagtgtttctcaattaatcaaagatgcaactggcggccttggtgtagattacgtctacgaatgtactggtgttccagctctattgaatgaggctatagaagcttccaaagtgggcttgggcacatctgttttgatcggggctggtttggaaacgtcaggtgaaatcaaatttatcccattgttatgtggcagaacagtgaagggctcaatttatggtggcgttagacctaaaagtgatcttccaaccattattgataagtgtataaataaggaaatccctatggatgagctgctaacccatgaagtctcacttagtgaaatcaacaaggctttcgagtatctgaagcaaccagactgtgttaaggtcgtgataaagttc

SEQ ID NO: 1157 - DNA, 1164 bp, Arabidopsis thaliana
atgtcgtggtggtgggctggagccattggagcggcgaagaagaagctcgatgaggatgagccgtctcaatcattcgagtcggtcgcacttatcatcggagttactggcattgttggtaactcgctggctgaaatcttacccctgtccgacacacccggcggaccgtggaaggtatacggtgtggcccgtcgaccccgaccgacatggaacgctgaccaccccattgactacatccagtgcgacgtctctgacgccgaagacacacggtcaaagctctctccgttgaccgatgtgacccacgtgttctacgtgacttggaccaaccgtgaatccgaatcggagaactgtgaggccaacggcagcatgttgaggaacgttctacaggctattatcccgtacgctccgaacctgcgacatgtgtgcctgcagaccggcaccaagcattacctaggaccctttacaaacgtggacggtccgagacatgacccgccgttcacagaggacatgccgcgattgcagattcagaatttctactacacccaggaagacattctgttcgaagagatcaagaagattgagaccgtgacctggtcgatccaccgacctaacatgattttcggcttcagcccctacagcctgatgaatatcgtgggcaccctgtgcgtctacgccgcgatctgcaagcatgagggtagcccgttgctttttcccggatctaagaaggcctgggaaggattcatgacagcttcagacgcagaccttattgcagagcaacaaatttgggccgccgtggacccctatgctaagaacgaggccttcaattgcaacaacgccgacatttttaaatggaaacatctctggaagatcttggccgagcagtttggcatcgaggagtacggattcgaggagggaaagaatctaggcctggttgagatgatgaagggtaaggaacgcgtgtgggaagagatggtgaaggaaaaccaactgcaggagaagaagctcgaagaggtgggagtttggtggttcgccgatgtcatcctgggcgttgagggtatgattgatagcatgaacaagtcgaaagagtacggcttcttgggatttcggaactccaataactccttcattagttggatcgacaagtacaaggctttcaagattgttcct

SEQ ID NO: 1158 - DNA, 1167 bp, Digitalis lanata
atgagttggtggtgggccggtgccatcggagccgctaaaaaacgactggaggaggatgacgcccagccgaagcattcgtcagtagccctcatcgtgggcgttactggcatcattggtaactctctggccgaaatcctgcctctggccgacactcctggaggtccgtggaaggtctacggcgttgcccgacgaacacgaccagcctggcatgaggacaaccctataaactatgttcagtgcgacatctcggaccccgacgactcccaggctaagctttcgcctctgaccgacgtcacgcatgtcttctatgttacatgggcaaaccgatctaccgagcaggagaactgtgaagcaaactccaaaatgttcagaaatgtcctcgacgcagtcattcctaattgtcccaaccttaagcacatctccctccagactggacgaaagcattacatgggccccttcgaatcctacggcaagatcgagtctcacgaccctccatacactgaagatctgccccggctcaagtacatgaacttctactatgatctggaggacataatgctcgaggaggtggagaaaaaggagggcctcacctggtccgtacatcgccctggcaatattttcggattctctccctacagcatgatgaacctcgttggcaccctgtgtgtctacgccgcaatctgtaaacatgagggcaaggtgctgcgatttaccggttgcaaggcggcatgggatggctacagtgactgttctgacgccgacctgattgccgagcatcacatttgggcggccgtggacccttacgccaagaacgaagccttcaacgtgtctaacggcgacgtattcaaatggaagcatttttggaaggttctggctgagcagttcggagtcgggtgcggggagtacgaagagggtgttgacttgaagttgcaggatctgatgaaaggcaaggaacccgtgtgggaggagattgtccgagaaaacggcctgacacctactaaactgaaagatgtcggcatctggtggttcggcgacgttattctgggcaacgagtgctttcttgactcgatgaacaagtccaaggagcacggatttcttgggttccgaaactctaaaaacgctttcatttcctggatcgacaaggctaaagcctacaaaattgtcccg

SEQ ID NO: 1159 - DNA, 1188 bp, Nepeta mussinii
atgtcgctgtcatggtggagagctggagctgctaagaagcgaatggatgatgatgaatcccttcttgtcaagcaacagcagcagcagtgtgtcgccctgatagttggcgtcactggacttgttgggaactctctcgctgaaatgctccccctgcccgacactcctggaggaccctggaaggtatacggtgtcgctcgaagagcccgaccaagttggaacgaggaccagccaatgacatatatttcgtgcgatgttagcaacacgggcgaagtggaagccaagctctcgcctctctccgacgtcacccatattttctacgctacatggactagccgcagtacagaggaggagaactgcgaagctaacggcaagatgctgaagaacgttctggacgccatgatccccaattgccccaacctcaagcacatctgcctccagaccggccgctttcactacgtggcatctgttgtggactggaagattaacggctcccacgacacccccctaactgaggacctgcctaggctcaaaaccaacaacttctattacacccaagaggacatccttctcgaggaggtgaagcggaaggagggtctgacctggtcggtgcatagacccggcactattttcggtttctctccgtactctatgatgaacctggtcggcactttatgtgtgtacgctgcgatctgcaaacaagagggtgctgttctacgttttcccggctgtaagggtgcctgggacggtcactcagactgtgcagacgccgacttgatcgccgagcagcagatctgggctgcactggacccgcatgctaagaaccaggccttcaacgtcagcaacggggacctattcaaatggaagcatctgtggaaggtcttggccgatcaatttggtgtggagtgtggtgactacgaggaaggccagcagctccgcctacaggacgtcatgaaggacaagggacctgtgtgggataaaattgtcgccgagaatggactgtccaacaccaagctggaggacgtcggtaaatggtggttctccgacacaattctgtggaacgagtgccgactagacagtatgaacaaaagcaaagagcacggcttccttggcttccgaaactcgaagaactgcttcctatactggattcacaaggtgaaggcctacaacctcgtcccgtccacctataca

SEQ ID NO: 1160 - DNA, 1191 bp, Nepeta cataria
atgtctatgaactggtggcgtgatggagcggccaagaaacgaatggatgagagctccgcggtgaagctccagcaacaacaatgtgtcgcccttattgtcggtgtcaccggcctcgtgggcaactctctggccgagatgctgcctctttctgatactccgggcggcccttggaaggtatacggggtggcgcgaagaccccggccctcgtggaacgaagaccaccccatcaactacatttcttgcgatgtctcaaacacagccgaggtcgaggctaagttgcctcccttgtccgacgtaactcacatcttctacgctacttggacgtcgcgaagctctgaggaagagaactgtgaggccaacggaaagatgctgaagaacgttctcgacaccatgatccctaattgccctaacttgaaacacatttgtttgcagaccggacgctttcactacgtggcttcagtcgttgactggaaaatcaacggatcccatgacacccctctgacagaagatctcccccgtctgaacaccaacaacttctactacacccaagaggacattcttctagaggaagtcaagcgaaaggaagggctgacttggtctgtccatcggcctggaactatctttggattttccccgtactcaatgatgaacttagtgggcactctttgcgtctacgctgccatctgtaaacaggagggcgccgttttgcgattccccggttgcaagggtgcctgggacggatacagtgactgcgcggatgcagacctgattgcggagcactatatttgggccgcccttgacccacacgcgaagaaccagtctttcaatgtgtccaacggagatgttttcaaatggaagcacctgtggaaggtccttgccgagcagttcggagttgagtgcggtggctacgagtacgaagagggccagcaagtccgactccaagacgtcatgaaggataaggggcccgtgtgggacaagattgtccgagagaatggattgtcgaacacaaagctcgaagatgtcggcaagtggtggttctctgacactattctttggaatgagtgtcgactcgactcgatgaacaagtcaaaagagcatggatttctcggtttcagaaactccaagaattgcttcctgtactggattcacaaacttaaggcctacaagattgtccccagctctacaatttct

SEQ ID NO: 1161 - DNA, 1164 bp, Catharanthus roseus
atgtcctggtggtggaagcgaagtatcggtgccggaaaaaacctgcccaaccaaaacaaggagaacggtgtttgcaagtcttacaaatctgtggctctggtggtcggcgtcaccggcatcgtgggatccagtctcgctgaggtgctcaagctcccggacacccctggaggtccttggaaggtctacggagttgccagacggccctgccctgtatggttagctaaaaagcctgtcgagtacatccagtgcgacgttagtgataaccaagagacaatttcgaagctctctcctcttaaggacattacccatattttctacgtgagttggattggctcagaggattgtcagactaacgctactatgttcaagaacattcttaactcagtcattcccaacgcctcgaacctgcagcatgtgtgccttcagaccggaatcaagcactactttggaatcttcgaggaggggtctaaggttgtgcctcatgatagcccattcactgaggacctcccccgactcaacgtgcccaacttctatcatgacctggaggacatcctctacgaggagaccggcaaaaacaacctgacctggtctgtccatcgaccagccttggtgttcggcttcagcccctgctcaatgatgaacattgtttccacactttgcgtttacgcaacaatttgtaaacacgagaacaaagccctggtttaccctggctccaagaactcttggaattgttacgctgatgctgtggacgctgatctggtggcggagcatgaaatttgggccgccgtagatcccaaggccaagaatcaggtgctcaactgcaacaacggtgacgtatttaagtggaagcatatttggaagaagctcgccgaggagttcggtattgaaatggtaggttatgtcgagggaaaggagcaagtctctttggcggaactcatgaaggataaggaccaggtctgggacgagattgtcaagaagaacaacttggtgcctaccaagctgaaggagatcgcggccttctggttcgctgacattgccttttgtagcgagaacctgatctcttctatgaacaagtccaaggagctcggttttcttggattccgcaacagcatgaagtcatttgtgtcgtgtattgacaagatgcgggactaccggttcattccc

SEQ ID NO: 1162 - DNA, 1164 bp, Catharanthus roseus
atgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccg

SEQ ID NO: 1163 - DNA, 1188 bp, Nepeta mussinii
atgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacg

SEQ ID NO: 1164 - DNA, 1191 bp, Nepeta cataria
atgtctatgaactggtggagagatggagcggctaagaagaggatggatgaatcctcggccgttaagctacaacagcaacagtgtgtggccttgattgtaggtgttacgggtctagttggaaactcacttgccgaaatgctgcccctttcagacacaccaggagggccctggaaggtatatggtgtggccaggagaccaaggccctcatggaatgaagatcacccaataaattacatttcatgtgatgttagtaacactgctgaagttgaggctaaactgccacctttgtcagatgtaactcatatattttatgcaacttggacatctagatcctcagaggaagaaaactgcgaagcaaacggcaaaatgttgaagaatgtattggataccatgatccctaattgtccgaatttgaagcatatttgcctgcagaccggtagatttcactatgttgcctcagttgtggattggaaaatcaatgggtctcatgatactccattaacagaagacttacctagattaaatactaataacttttattatacacaagaagatattctgctcgaagaagtgaaaagaaaagaagggttaacctggtctgttcaccggcctggaactatttttggtttctccccttatagcatgatgaatctcgttggtactctgtgtgtgtatgcagcaatttgtaaacaagaaggtgcggtcttacgattccccggttgtaagggtgcatgggatgggtatagcgactgtgctgacgcggatttaatcgcggaacactatatttgggcagctttagacccacacgctaagaatcagtctttcaatgtctcgaacggtgatgtttttaaatggaagcacctgtggaaagtgttagcagaacaattcggtgtcgaatgtggcggttatgaatatgaggaggggcaacaagttcggcttcaggacgtaatgaaagacaaagggccagtttgggacaagatcgttcgcgaaaatggattgtcgaacacgaagctagaggatgttggtaagtggtggttttcagatacgattttgtggaacgaatgtagattggatagcatgaataaatccaaggaacatggattcttaggcttccgcaactcaaagaattgctttctgtactggattcacaaattaaaagcttataagattgttccttcctccactatttca

SEQ ID NO: 1165 - DNA, 1176 bp, Olea europaea
atgtcctggtggtttaatcgttcagttaacggatgtaaacaaaaaaaaatccaggaaaatggtgttcaacagcagcagaatggcgatattcaaagttttaaatctgtagccttgattgtaggtgttactggcattgtcggatcgtctttaagtgaaattttacaatatactgacacgcccgggggtccttggaaagtttatggagtagccagaaggccaaggcccacatggttggctaaatcacatgttgagtatgtccaatgtgatgttacaaatactgaggagaccatttctaaaatatcaccacttactgacataacacacattttttatgtatcttggatgggtaatgaggattgtagtatgaacgctgtaatgttccagaacatacttaattcggttattcccaatgcgcctaatctgcagcatatttgtctacaaacaggcagtaaacattacattggccttttcgaaaccgatactcctgagagtcatgacactccatactccgaagacttagctaggctcaaacaacccaacttttaccataaccttgaggatattttatttgaggaaactgcaaagaagggcttaacttggtcagttcatagaccagccttgatattcggattttcgccctgctcactgatgaatattgtatctaccctgtcagtttacgctgcaatatgtaaacatgagaacaagccattagtttatccaggtagcaaagccagttggaattgttttgtggatgccgctgatgctgaattagctgcggaacaccaaatttgggcggctgttgatccaaatgcgaagaatcaagctttcaattgtaccaacggcgacttattcaagtggaaacatatttggaaagttttagccaatcaattcgatttggaaatggttggttatatagaaggtaatgagcaagtgtcaatggaagaattaatgaaagataaggattccgtatgggacgaaatagttaagaaaaacaacttgatgccgactaaattaaaagaaatcgccgcattctggttcgctgacattgctttttgtcttgaaaacgttctctcgtcgacacacaaaaatcgattgcatggcttcatgggttttcgaaatacatatactagttttgtgagctgtatcgataaaatgagagcttacaggttcattcca

SEQ ID NO: 1166 - DNA, 1101 bp, Catharanthus roseus
atgggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccg

SEQ ID NO: 1167 - DNA, 1110 bp, Nepeta mussinii
atgcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacg

SEQ ID NO: 1168 - DNA, 1119 bp, Nepeta cataria
atgcaacagtgtgtggccttgattgtaggtgttacgggtctagttggaaactcacttgccgaaatgctgcccctttcagacacaccaggagggccctggaaggtatatggtgtggccaggagaccaaggccctcatggaatgaagatcacccaataaattacatttcatgtgatgttagtaacactgctgaagttgaggctaaactgccacctttgtcagatgtaactcatatattttatgcaacttggacatctagatcctcagaggaagaaaactgcgaagcaaacggcaaaatgttgaagaatgtattggataccatgatccctaattgtccgaatttgaagcatatttgcctgcagaccggtagatttcactatgttgcctcagttgtggattggaaaatcaatgggtctcatgatactccattaacagaagacttacctagattaaatactaataacttttattatacacaagaagatattctgctcgaagaagtgaaaagaaaagaagggttaacctggtctgttcaccggcctggaactatttttggtttctccccttatagcatgatgaatctcgttggtactctgtgtgtgtatgcagcaatttgtaaacaagaaggtgcggtcttacgattccccggttgtaagggtgcatgggatgggtatagcgactgtgctgacgcggatttaatcgcggaacactatatttgggcagctttagacccacacgctaagaatcagtctttcaatgtctcgaacggtgatgtttttaaatggaagcacctgtggaaagtgttagcagaacaattcggtgtcgaatgtggcggttatgaatatgaggaggggcaacaagttcggcttcaggacgtaatgaaagacaaagggccagtttgggacaagatcgttcgcgaaaatggattgtcgaacacgaagctagaggatgttggtaagtggtggttttcagatacgattttgtggaacgaatgtagattggatagcatgaataaatccaaggaacatggattcttaggcttccgcaactcaaagaattgctttctgtactggattcacaaattaaaagcttataagattgttccttcctccactatttca

SEQ ID NO: 1169 - DNA, 993 bp, Nicotiana tabacum
atgggtctgggaccctatactgtttatttcgatgctttatgtatcggcttgggagcaattctaatgcaagactcgcgtatgattgcttacgcctcgtatcaattgaatacacacgaaaagaattaccatgtacatgacttagaattggcaagtattgtacatacgttgaatatttggggcgctttgattgttagaagagtaatgggcgttactaaaaaatattcggatttaaagcagcattacttgtggagaaagatggagaaagatatcataggtcacgtttcacaatgcttaaattgtcaacaagtcaaataccaaaagctaggtggcttgacacaaagattaacgaaatctgttcatttcatacccgtaattacgtcctatacttcagaaagaaagccttccattacttggtctgttcatagacctgatatgatttttggtttttcgccccattcgacactaaacatagttgggacgctttgtgtatatacaactatctgcaaatacgaaggaatacccttgaagttcccgggtacgaaggcccgttgggatagttattctaatgctagcgacgcagacttagttgcagagcatgaaatatgggcagccttatgtcccagggctcaaaacaaggcgttcaatattacaaatggtgacgtctttaaatggaagcatctttggaaagtgctagcggagcaaattggagtagagtacgtgggttttgacgaaaccgaaaaacgtatttgtctagcggaaatgatgaaagacaagggtcacgtatgggacaaaatcgttcgagataataacttggtttcaactaccctggaagaagttggcttatggcaattcgctgatatgatattagccgggggatcaaaccgattatcttcaatcaatagaagtaaggagcacggtttcatgggattcagaaacagtacgaacagctttatattctggatccagaaagctaaggacaatcgtttaataccc

SEQ ID NO: 1170 - DNA, 1200 bp, Elaeis guineensis
atgtcttggtggtgggcaggtgcaataggagctgctagaaagaaatttgatgaagactcaggtggtgggggtgcagctgccaaattcccttctgttggtttggtaatcggtgttactggtatagtcggtaattctttggctgaaattttacctttggccgacacacccggtggtccatggaaagtgtatggagtttctagaagacctcacccctcttctcttgcctcccaaacagagggtctggcgatagaacacgtccagtgtgatatctctgatagagaagacgcacttgctaagctcagccccctaactgatgttacccatatattttatgtggcttgggttaataggtctactgaagcagaaaatcgagagattaactcagcaatgttaagaaatgttctaactgccgttattcccaatgcacctaacctgcaacacgtatgcctgcaaacaggtagaaagcattatctagggagtttcgaatcactgggtaaagttaagggtcatgaaccaccgtttgtcgaggacttaccaaggttagactgtccaaacttctactacgatctcgaagatatattatttgaagaagttgcaaagagagagggcgccgttacttggtctattcataggcccactaatatattcggtttctcaccatcatctctaatgaatctgatgggtattttgtgtgtatatgcagctatctgcagaagagaaggcgtaccattgcgctggcctggttccagagttctatgggagggtttcagtgacgctagcgatgctgatttgatagcagagcaccaaatttgggcagcggtcgatccttacgctaaaaatgaggcctttaattgttctaatggtgacgtttttaagtggaagcatttgtggccgttactagctaaagaatttggcgtcgaatgggtggggtaccagggcgaggaagctcgttttaaactagaggacgcaatgaagggaaaggaaggattatgggaaaaaatggttgcggaacacgaattagcaccaacgcggttggaacaagtcggaaactggtggtttgctgatgttgtgctgggtcttgaagaagaatatttagactccatgaataaatcaaaagaacatggcttccttgggtttagaaacacagtgactagtttcaattcatggatcgataagattaaggcttataagatcgtacct

SEQ ID NO: 1171 - DNA, 1200 bp, Citrus clementina
atgtcttggtggtgggcaggtgccataggcgcagcgagaaaaaaatttgaagaggatgagcctgcaaggtcatatcagtccgtcgcgcttatcgtaggagttactggcattgtcggtaactctctagcagagattctgcctcttccggatactcctggtggtccatggaaggtgtacggggtcgctagaagaccaaagccgaattggaacgccgatcacttagttgaatatgttcagtgtgacgtttctgatcccgaggaaactcaggctaaattgtcccagctcacagacgtaacccacatcttctatgtcacttggacaaatagatccaccgaagccgaaaactgcaaaattaatggttctatgtttagaaatgttttacgtgcagtcattcccaatgccccaaatctcagacatgtctgcctgcagactggtacaaagcactacttaggaccatttgaagctttcggtaaaataaaaccgtatgatcctccctttacagaagacatgccaagattagatgccccaaatttttattacacattagaagatatccttttcgaggaagtggaaaagaaggaagaattgagctggtcagtccatcgcccggatacaatcttcgggttctccccatattcattgatgaatctggtcggtgctttgtgtgtgtatgcagctgtatgtaaacatgaaggtatccctttgcgatttcccggtaccaaggcggcttgggaatgctattccattgcctccgacgccgatttaattgctgagcaccaaatttgggccgcagtggacccttatgctaaaaacgaggcttttaattgtaacaacggagatgtttttaagtggaaacatctttggaaagttttagccgaacaatttgggatcgaagattacggcttgagtgaggaagaagaagaagaagaagaaggaggtggtggtacccaaagggttaaattagctgaatttatgaagggtaaagaaggcgtttgggaggagattgttagggagaatcaactgcaacccactagattggacgaggtcggtgcgtggtggtttgtggatttggttttgaccggcgaagctaaattggcctcaatgaataagtctaaagaacatggcttcagcggttttagaaattcaaagaactctttcataacctggattgacaaggcaaagggttataaaatcgtacca

SEQ ID NO: 1172 - DNA, 1173 bp, Sesamum indicum
atgtcctggtggtgggctggagccgttggtgctgcaaagcaaaagaaactagaagaggatgaagcacctcaaaaacatgaaagtgtcgcacttattattggcgttaccggcctagttggcaattccttagcggagattttaccacttagtgataccccaggaggtccttggaaagtgtacggtgtcgcgagacgtccgcgcccaagttggtccgacgattatccgattaactatatacaatgcgatgtattgaatcgtgatgatacacaagctaaattatctacattaactgacataacacacgttttctatgcaacatggactaacagaccaaccgaagctgaaaattgtgaagcaaacggtaggatgttacaaaatgttttagatgctgtgattcctaattgcccgaatttgaaacacatttgcatgcaaacgggtaggaaacattacgtgggtccattcgaagcatttggcaagttggaaacacaactagaaactccatatacagaggatatgccaagattgaattacattaacttttactacactttggaagatattttgtgtaaggaggtagaaaagaaagagggattaacttggtctgttcacagaccgggtactatatttgggttctccccacatagtatgatgaacttggtcggaaccttatgtgcgtacgcggcaatatgtaaacacgaaggtaaggttttgaggtttccaggatgtaaagaagcttgggatggatactcagattgtagcgatgcagacttaatagcagagcaccaaatatgggccgccgtggaccctcatgcaaaaaatgaagcttttaacgtcaataacggtgatgtctataagtggaaacacttatggaaggttttagcagaacagtttggtgtagaatgtggcgaacatgaagaggggcaaaccattacctttgaaggacttatgaaagacaaaggtggcgtttgggacgagatggtacgtgaaaatggccttacaccgactaaactagaagacgttggtttatggtggtttgctgatgttattttgggtaacaagtgcttccttgatactatgaacaaatccaaagaacatggattcttagggttccgaaatagtaagaaaagttttatttcttggatagaaaaagtcaaagcaaataaaatagtacct

SEQ ID NO: 1173 - DNA, 1167 bp, Camptotheca acuminata
atgtcgtggtggtgggctagatcacttggggcacagaaagaatttaaggaaaacggtgctttaactagttatcaatcagttggtcttattattggggttaccggcattgtaggtaactctttagctgagattctacctttaccagacacacctgggggcccgtggaaggtttacggtgttgcgagaaggccgagaccagcttggaacacggatcaccccatcgaatatatccaatgtgatgtggcttcaaccgaagacactttggccaaattgtccccattgaccaatataacacatatcttctatgttgcgtggaccggttctgaagattgcgaagttaatgagactatgtttcataatgttttaaaggcggttattcctaatgcgccaaaccttaggcatatctgtatccaaacaggtataaaacattatacaggccctctagatccagatggaggaattcagcctcatgactcaccattcaccgaagatcttccacgtttaaatgcacccaatttttatcataatttggaagacattttaattgaggaagccgcaaaaaaaaagggactcacctggagtgttcacagacctgcactggtgtttggtttttccccttatagtatgatgaacataattggagcgctatccgtttacgctgtgatctgtaagcatgaaaacaaaccattgatttaccacggtgcacctgataatagtcgtgattcatggaatgtttacgctgacgcggctgacgcagacttaatagccgaacatcaaatttgggcagcagtagactcgaacgctaagaatgaagtgtttaattgttcaaatggagatgtttttaagtggaaacaaatgtggaagattttagcggaacaattcgaggtggaacttgttggttatgaggatggtcaaaagagaatgtccctacaagaaagaatgaaaggaaaaggtccagtatgggatgaaattgttaggaaacacaaattgctgccaactaaactggaagacgtcgcacaatggtggtttgctgacatagtttctcagtcacaaaatttagttaatggtgttaacaaatcaaaagaaaatggctttttaggtttcagagacagtaaaaagtcctttgtatattggataaaaaaaatgagagctgcgaaaatcataccg

SEQ ID NO: 1174 - DNA, 1173 bp, Cinchona pubescens
atgtcttggtggtggaagagatcaatagatgcggggaagaattcgggcaaaaaattggaagttaatgaaaacgaggcaatagttgaagattacaagtccgttgctttagtggtaggcgtgacaggcatagtcggctcatctcttgctcaagtgttggcattgcctggcactcctggaggtccttggaaggtatacggtgtagcaaggagatcaagaccggtctggttcagcaaaaatcatctggaatatatacaatgcgatgtcagtaatacacaggaaacaatctccaaattgtctcctctaacagatataactcacattttctatgtcagctggatcggtagtgaagattgtgatataaatgctacgatgtttaaaaatattctgaatactgtaataccaaatgcgccaaagctgcaacatatatgcttacaaacaggtatcaagcattattttggaatttttgaggagggttctaaggtggaaccacacgatagcccattcacagaggatttaccacgtttagatgtacctaacttttaccatgaccttgaagacatcttgtatgaagaaactagcaagaacaatcttacatggtctgtccaccgacctgctttggttttcggtttttctccttgtagcctcatgaacattgcttctacattgtgtgtatatgctacaatctgcaaatacgaaaataaaccattggtctatactggatctaaagcttcctggaactgttatagcgatgctgtagacgccgatctaatcgctgaacaccaaatttgggcggccgtagatccaaaggccaagaaccaagtattaaattgtaataatggtgacgtgtttaaatggaaacatgtttggaagacattggctgagcaatttggccttgaaatggttggttatattgagggtaagcaacaggtttcacttgctgaattaatgaaagataaggacttagtttgggatgaaattgtaaagaaacataatttggctcctaccaagcttaaagatatcgctgccttttggtttgctgacattgcattttgttctgagaattttttatcttctatgaataaaaacaaagaattagggtttctcggttttcgagatagtattaagtctttcaactcatgtattgacaaaatgagagcatatagattcataccc

SEQ ID NO: 1175 - DNA, 1179 bp, Ophiorrhiza pumila
atgtcttggtggtggaaaaggtccatcggcgaaggtcaaaactctgctaagacgagtgaagaaatcaacggtctgaacggggaggacgaccaagactacaaatctgtgggcttagttgttggagtaactgggatcgtcggttcctccctggcacaagtcttgaccttgtctgatactcctaatggcccatggaaggtttatggtgttgcaagaaggagaaggccagattggttttcaaagcaacatttacattacatacaatgtgatgtttctaacacacaggaaaccatatcaaagttatccccattaacggatataactcacattttctatgttagctgggtcggatccgaagactgtgacacaaatgcaacaatgtttaagaatattgtgaatatcgttattccgaatgccccaaatttaaaacatataagtcttcaaactggttcaaagcattattttggaatttttgaggagggctctaaggttaagccaaatgaaagtccgtttaaggaggatatgccgcgattggatgttaagaatttttaccatgatctcgaagacatcttatatgaggagacctccaagaacggtttgacatggtccgtacaccgaccagcgctagtctatggcttttcaccctgctcgatgatgaatatagtcagtacattgtccgtttatgctactatctgtaaacatgagaatcggccattaacttatcccggctcaaaggcttcctggaattgttacgttgattgcgtagatgctgaccttattgcagaacatcatatttgggctgccgtggatccaaaagcaaaaaatcaaattctgaattgtaccaacggcgatgtatttaaatggaagcacatttggaaggcacttgctgaagagttcggtttagaaatggtaggctacattgagggcaaagaacaagttagtatggctgaactaatgaaggataaagatttggtgtgggatgaaattgtcaaaaaaaacaatctggtccctactaaacttaatgacatcgcagcattttggttcgctgatatcgcattcagctgtgtggatcttctgtcttctatgactaagtcgaaagaactcggcttcttggggtttcgtgacactatgaaaagtttctcttcctgtatagataaaatgagagcgtacagattcataccg

SEQ ID NO: 1176 - DNA, 1218 bp, Lonicera japonica
atgtcctggtggtggacaagatcaatcggtggtgaaaagggctcctcttatggtaagattgcggaacagaacggcgttcaagccaatggtaatagtcacttacataagaaggaggaaaacggtggcccagcaacttataagtcagttgcacttattgttggtgtaacgggaattgtcgggtcaagtctcgccgaaattttaccgctacaaaatacgcctggtggaccttggaaggtgtacggtgtcgcgagaaggccaagaccaagttggacagataagtccccgataaattatatccaatgcgatgttagcaacacgattgaaacagttgctaagctttctccattgacagatattacacatatattttacgtttcttggatgggttccgaagactgtgaaataaatgccattatgtttcaaaacattctggacgcagtcataccaaacgccccgaaccttaagcacatctccctacagacagggataaaacattacatgggagtgtttgagactgatacaaaacaaaaaccacacgattcaccatatactgaagacttaccaagactgaacgttcagaatttttatcataatctggaagatatattgtatgaagagaccgcgaagaaaggtttaacgtggtccgttcatagaccggcattggtcttcggtttctccccctgttcaatgatgaacatagtgtccacccttagtgtctatgctgcaatttgtaaacacgaaaacaaacctttggtctaccccggctcgaagggaagttgggattgttatgctgacgccgtcgatgctgatctaatcgcagaacaccacatatgggccgcggttgaccccaaagccaagaacgaaatatttaattgcaacaacggggacgtttttaaatggaagcatatatggaaagccttggctgaaaagtttgagctggaaatggttggttacgaagaaggtaaagaacaggtatctatggcagaaatgatgaaagacaaggaggaagtttgggatgagattgtcagagaaaacaaattggttcctacaaaattaaaggatatagccgcatggtggtttgctgatatcgcgtttgttactcaaaatgtcttatcaagtatgaacaagaataaggagcatggatttgaaggattcagaaattcaacaaagagtttcgtgtcatgcatagacaagatgaaagcttataggattatacca

SEQ ID NO: 1177 - DNA, 1182 bp, Digitalis purpurea
atgtatactgatacgacgacatggtggtacaagagatcaattggtgacatcgaacagaaaaatgttgaaaccaatggtgtcgctttgaactataagagcgttgctctgattgtgggggtgacaggcattgctggatccggtttggcagagacattatctaaatcggatactcctggtggaccgtggaaagtgtacggcgtggcaagaaggccatgtccagagtggttggctaaactccatgtttcctatattcaatgcgatatcggttcgaccgatgatacatctgcaaaattatccccgctgtctgatatcacgcatatattttacgtctcctggacgggctccgaagattgcgataaaaacgccatcatgtttaagaatatcctcgattcagtaatcccaaatgcccctaacctaaagcatatttctttacagaccggcattaaacattactggggtaatatggttgatgagatggacaccaccaatgtttctcatgactgtccattttatgagaacatgcctagactcagacagcctaatttttattataatctcgaggatcttctctatgaagcttgtggtactcaaaacggtgccttgacatggactgtgcatagaccagctttgatcttcggtttctctccttgtagcttaatgaacattgttgcaacattaagcgtgtatgctgccatctgcaagtacgagaacaaacccctggtgtatacagggacggagacttcctggaattgtttggtagatgctgtcgacagcgatctattggcagatcatctagtttggggtgccatctcccctaacgctaaaaaccaggcttttaatatcaataacggtgacgtgttcaagtggaaacatatttggaaggtccttgcggaccaatttgaaattgaatttgtcggatacgaaggtaaagagccagtctcattagaaggtctaatgaaagacaaggatagtgtatgggatgaaatagtcgagcgatacgatttggttcctaccaagttgaaagatattgctgcgttttggtttgctgacgtagctttttctatagaaggtgctgtctctagcatgaataagaacaaggaatttggtttcatgggatttagagactctacgaaatcgtttatttcctctgtcaacaaagtcaggacctataggtttgtcccc

SEQ ID NO: 1178 - DNA, 1167 bp, Antirrhinum majus
atggcgtcatggtggtggaaaggtgcgattggtgcggcaatgaccaaaagcgaagataacgataaagcaccacagaacgtggcgctgatcgtgggtgtaactggcatagtaggtaattcacttgcagaaatcttaccggttagcgataccccgggcggtccatggaaagtgtatggcgtagcacgtcgacctcgtcccgcctggaatgccgatcacccggttcagtacattcagtgcgatgtgagcgaccctactcagacacagagcaaactagcaccccttacagatatcacgcatatattttgggtgacgtgggccaaccgcccgacggaagcggaatgctgcgatattaacggcaccatgttacagaacgtatatgatgctttactgcctaatgcgccgaatttgacgcatatctgcattcagacaggccagaaacattatattgggccattcgaaactttcggcaaagtcaaaccgcacgaaacgccgtttgttgaggatgtcccgcgtctcgatgttcctaacttctattacacgcttgaagacctcaccctggaggcgtgcaaaaaaaaggaaggtctaacctggtcggtgcatcgtcctgcggccatttttggtttctcgccgcacagcatgatgaatatgatggattcattatgcgtatacgcggcgatttgtaagcacgaaaatgttccattgaaatttccaggtaccaaggcctcttggaattgctattttgtgtgttcggacgctgatctgatagcggaacagcagatttggagctccgtggatcttaatggcaaaaacgaagcattcaactgttcgaacggtgatttgttcaaatggaaacagatgtggaaagtgctggccgatagttttgaagtggaatacgaagaatttgatgaaaatcaagagtacgttagcctggccgaacgaatgaaagacaagggcccggtatgggacgagatcgtcgagaaaaacaacctcctgcctacaaaacttgaggaagttgccactttctggttcgcggatctgatgttttatggtgaatgtatgctcgacaatatgaataaatctaaggaacatggcttctttggcttccgcaacagcgaaaaaaccgttctatcagtaatcgataaaatgaaagcgcacaaaattgttccg

SEQ ID NO: 1179 - DNA, 1098 bp, Trifolium subterraneum
atggatgagggcgtgaaaggaagctgcgaagaggatgaagagttcaaggaagcaccccgttcatcccagaatatcgcactcatcatcggcgtgacgggaattgttggaaacagcctcgccgaaattctgccattaaaagatacccctggcggaccatggaaagtgtatggtgtcgcgaggcgcccacgcccgatgtggaatgcggacaaccctatacactacattcagtgcgatgtaagtgaccaaaatgatgttgagctgaaattgaccaccctgacggacgtcacacacatcttttacgtctcgtggacctcacggccaacggaagcgcagaattgtgaagtgaatggctcaatgctgcgcaacgtgctacgctctttaattccgaacgcgcctaacctatgccatgtaagcttgcagacaggcgccaagcattatgtgggcccatttgaaactatcggtaaaattaaaccgcacgagtccccgttcatggaagatgtcccgcgtctggatacgcttaacttttaccacacccttgaagacatcttgtttgaggaggtggggacctgtatgatgaacctaatcggaacgttatgtgtgtacgcggcgatttgcaaacacgaaggattaccgctacgattccctggctcgaagggcgcgtgggaatgttacagcactgcgtcggatgctaatctgatcgccgagcagcatatttggggcgcagttgactcaaacgcgaggaataaagcatttaactgctcgaacggcgatgttttcaaatggaaacatttgtggaaagtattagcggataaatttggcattgaagattacggcttcgaagaaggattggagcttaaattgacggaggttatgaaagataagcgcggggtctgggaggaaattgtccgtgaaaatgggctacagccgaataagctggaagatgtaggcgactggtggttcgcggactttactctgcgcgtggaaggcgtgttggattccatgaataaagcaaaagagcatgggttcctgggttttcgtaacagcaaggacagctttgtgagctggatcgatatgacgaaagcctacaaaattgtacca

SEQ ID NO: 1180 - DNA, 1356 bp, Corchorus capsularis
atgggagccaatcagaaaaaagtaaaattaaataaggacgacgggtcagttctggcgttctggacgacactgggctcgggtcagtcattttgggtacgtaaaatcacatctttttattttcgtagttgcttcgaagactttgcacacctgcgtatcagcagctgggattttgatttcggagtgggctgtggctttcgtgtagaatggggagccctcgaaaaaaaattcgaaggcgatgaagcaccgtcaaattttgaaagtgtggggctgatcgtgggggtgaccgggattgtgggtaatagcttggcggaaattttaccgcttagtcatgacactccgggtggtccctggaaggtttacggcgtggcccgccgcccgcgcccgtcgtggaatgccgatcaccccatcgagtatattcagtgtgatatttccgatagcaaagatacagaagcgaaattaagcccgctgaccgatattactcacattttttatgttagttggacgaaccgttcatccgaagcggaaaactgcaaaatcaatgggtcgatgttccgcaatgtactgcgtgcggttatccctaatgcgcccaacttacgtcacatttgtctgcagactggtggcaaacactatgtgggcccgtttgaatcattttgtaaaattcagcttcatgaaccgccctttacagaagatctcccgcgccttaatacgccgaatttttattacacccaggaagatattctgttcgaagaagttcagaaaaaagagggtctgacttggagcgtacatcgcccaaccgcgacctttggtttctcaccgtactcattgatgaacgtgattggcactctatgtgtatacgcggcaatctgcaaacatgaaggcaaaccgttgctgtttccaggtaacaaagacgcgtgggagggtttcagcgaagccagcgatgccgatttaattgcggaacatcagatttgggcggccgtggatccttacgcaaaaaatgaagcgtttaatgtgtcaaatggcgacctcttcaagtggaagcacttatggaccgtcttggcggaacaattcggcattgaagaatacggcttcgaagaaggaaaaaatttaggcctgcaggaaatgatgaagggcaaagagcgcgtttgggaagagattgtgaaggagaatcagttgcaagaaacgtcgctagcggacgtgggagtgtggtggttcgccgatctggtgttgagtgtttcggcggcgatggctatgttatctatgaataaaagcaaagaacatggcttcttgggcttccggaattcgaaaaatagctttgttacttggattgataaaatgaaggcgtacaagatcgtaccg

SEQ ID NO: 1181 - DNA, 993 bp, Nicotiana tabacum
atgggtctgggaccgtatactgtatattttgatgcgctgtgcattggccttggcgccattctgatgcaggattcacgtatgattgcatatgcgtcgtatcagttgaatacccatgagaagaactatcacgtacacgatctggaactggccagcattgttcacaccctaaacatctggggtgccctaattgtgcgtcgcgtcatgggtgttaccaaaaaatattccgatttgaaacagcactatctgtggcgcaaaatggaaaaggatatcatcggacatgtcagccaatgtctgaactgtcaacaggtgaagtatcagaaactgggtggtcttacccagcgcctgacgaaaagcgtgcacttcatcccggtgattacctcttataccagcgaacgcaaaccttcaatcacttggtcagttcaccgcccggacatgatcttcggcttttcacctcatagcacattaaacatagttggtaccttatgcgtgtataccacgatttgcaaatatgagggcattccgcttaaatttcctggcacgaaagcgagatgggatagctatagtaatgcaagcgatgcggatctagtagcagaacatgaaatatgggcggcgctgtgtccccgtgcccaaaacaaagcgttcaacattacgaatggtgacgtgttcaaatggaaacacttgtggaaagtactggccgagcagattggagtggaatacgttggcttcgatgaaacggaaaagcgcatctgtctggccgagatgatgaaagataaaggtcacgtgtgggacaaaatcgttcgtgacaacaatctggtttccaccaccctggaagaagtgggactctggcaatttgccgatatgattttggcgggtgggtctaatcgcctgtcaagcatcaaccgtagcaaggaacatggttttatgggctttcgtaattcaaccaactcgtttattttttggattcaaaaagccaaagacaatcgcctgatcccg

SEQ ID NO: 1182 - DNA, 1227 bp, Panicum hallii
atgattcgttggtgctggactggagaacacggcgcagtccaggagcgtcgcgccgccgataccgaggctgcggcaccggcatttgccaatgtcgcccttgtagtagggtcgaccggaacagtaggcgccgcgctggtcgacatgctccaaagcactgatgcgccggcgggcccgtggaaggtatatgccctgtgccgccggccactcccgccttggtgtaccagtggtagtgcagcgtccacaagctcaccgaacgccgtcgtcgtgtcgcttcaagttgatttggcgaatgctgccgcggtggcagcggctctggcccccctagcggatatcacccacgtgttttatgccgcgtggagcccccaacgtggtagtccagatgctgtagcatgcgaaacgaaccgcgcgatgctgcgtaatgtgttaagcgcagtggttccgtcttgcccggcgttagcgcatgtttgtctgcagaccggtagagatcagttcgtggacccgtttgatcctgtgatgggtaccacctctgcgacccgtccgtactccgaagatcttccgcggctggaacatccggatcttgaagatgtgttactgattgaattacctggctttgtggcgtcacgccgtgatcgtgccccggtgacgtggtcggtgcaccgccctgcgacggtatttggtttttcaagccgcagtgggcgcaatgttgtctcttcgctgtgtgtgtacgcggcaatttgccgcaaggaaggcgcagcgctccgctggccgggcagtcgggtcgcctgggaaggtttctcggatgcgagcgatgctgagttggtggccgaacatgcgctctgggccgctctggaactacgctgtaagaatgaagccttcaactgcacgaatggtgatgtttttaaatggaagcagctgtggccagccctggcgaaacacttcgcggtggaatggagcggctatgatggagaggacaaacgctttaagttagaagaggcgatggcgggcaaagaagcggtgtggacggaaattgtgagagaaaatggcctgctggagactaaactggacgataccaccacttggtggagcgttgatgcagtactgaatgcagatcaggaacaggttgataccatgaacaaatccaaagagttgggattttttggtttccgccatacggttagaagctttgatacctggatcactaaactgaaagccagcggcatcgtgccc

SEQ ID NO: 1183 - DNA, 1098 bp, Medicago truncatula
atgattagcgatttgagcatctaccactttggtgcacatcatatcaccgaatttaaggaaagcccgcgcagctttcagaacgtcgccctcattattggagtgacagggatcgtcggcaacagcctggccgagattctgccactcgacgatactccgggcggcccgtggaaagtttatggcgtagcacgtcgtccacagcccaatctgagtccgctgaccgacgtgacccacattttctatgtctcttggactagtatgcctacggaggcccagaattgcaaagtaaatggtagcatgttacgcaatgtgctgcgcgcacttattccgaataccctgaatctgtgccacgtcagcctgcaaactggtattaagcactactttggaagtttcgagatagttggcaaaattaaaccgcacgaatccccctttaccgaagatgtaccgaggcttgtgactccgaatttttatcacacccaggaagacatactattagaagaagtaggaaaaaaaaaaggcatgacgtggtttattaaccggcctcaggtaatttttggctttagtccgtatagtatgatgaacctaattggtacactgtgtgtgtatgcagccatttgcaaacacgaaggcctgccgctacgcttcccgggtagcaaaggcgcctgggaatgctactctactgcgagcgacgcgaacctgattagcgaacagcatatttggggcgcagttgatccgaacgctaagaacgaagcatttaactgtagcaatggtgacgtgttccgatggaaacacttatggaaagtgctggcggaacgttttgaaattgatgattacggtttcgaagaggggagcgagctgcgactgagcgacctgatgaaagataaaggcggtgtgtgggaagaaatcgtgcgcgagaatgagttactgtatacgaaactggaggaggtgggcgattggtggtttgcagacttcatgtttcgtgtcgagggcgtgttggatagcatgaataaaagcaaagaacacgggtttctgggatttcgtaatagcaagaacgtttttattagctggatcgacaagaccaaagtgtacaaaatcgtgccg

SEQ ID NO: 1184 - DNA, 1179 bp, Juglans regia
atgattacgtggctgtgggcccgcgccgtgggcgcgacgaaaaagatcaacgaagcagaagaggccgtgttaccgccgggtagctaccagagtgtagggcttgtaatcggtgtaactggcattgtgggcaactcccttgcggaaatattgccgctgccggatacgcctgggggtccgtggaaagtctacggcgtggcacgtcgtcctcgcccgaaatggaatgccaaacatccggtgcattatattcagtgcgatgttagcaactcagaggaaactgaagcgaaactgtcgcagctggcagatgtgacgcacatcttttatgtcacgtgggcgtcccgtcaaacggaggccgagaattgcgaagttaacggagccatgttccgcaatgtgttgcgcgccctgattcccaatgcaccgaaactccgccatatttgcttgcaaactggtgcaaagcactacattggcccgttcgaagcatttggtaagatacagccgcatgagccgccgtttacggaagacttaccgcgccttaatgtgccgaacttctattatacccaggaagatattctgtttgaagaagccaaaaaaaaggaaggtctgacctggtctatccatagaccaaacattatttctggcttctcgccgtattcgatgatgaacatcatcggcaccttatgcgtgtacgcggcgatttgcaaacacgaaggcctgccgctgaaattccctggtaacaaagcgagctgggaggggtacagcgtggcctctgacgcggacctcatcgcggagcagcacatttgggccactgttgatccgaacgcccggaatgaagcgtttaattgcaataatggcgacgttttcaaatggaaacacttatggaaggtattagccgaacgttttggtattgaaaagtatggttttgaagaaggcgaaaaggtctcgctagttgaaatgatgaaggacaaaggaccggtttgggaggaaattgttcggaaaaaccatcttcaacccaccaaacttgaggaagttggtgtgtggtggtttgcggacctttttctgtgtgtagagggtgcccttgatagtatgaacaaatcgaaagaacacggctttctgggcttccgtaactcgaagactagcctgatcacctgggtggataaaatgaaaggtcacaatatcgttcct

SEQ ID NO: 1185 - DNA, 1002 bp, Triticum urartu
atgaaaaaaattgccggcggaaaagcatttatcatgcagagcaaacatatgaaagtgaattatctgctattaactcaggtccggaatagcccgggcgcgtttacggatctgccgcgctcggcgtcagatgccgcggcctactaccgcagtgaggagggctcaagcaccgaaaaagtattttggtctcagtacgctgaagccggacatctggtcccgttatcagaccaactgaaacagatggttgagctgcacaaaccgggtcgtaaacactacattggcccttatgaggcaattggcaaaattccggtacccgatccaccctacactgaagacatgccgcgcttagattatcccaatttttactacgatcaggaagatgtcctgttcgaagaagtgagccgccgtgatggtgccgtgtcctggagtgtacatcgtccgtcagtcgtgttcggcttctcgcctcgctcggcaatgaatgtcgtggcctcactgagcgtctatgctgcgatttgtcgtaaagagggcgcgatgctgcgttggcccggaagccgcgtggcctgggaaggttttagcgatgcatctgacgcagatctggtagctgagcaggaaatctgggccgccgtggatccgttagcccgtaatgaagcctttaattgctcgaatggcgatctgtacaaatggaaacagctgtggcccatggttgcggatcgctttggcgtagagtgggcgggttatgagggcgaggattctcgttttatgctggcagatgctatggccggcaaggaagcggtatgggcagagattctgcaagaaaatgaactagtaactaccgagctgcaggagattgccaactggtggttcctggatgctgtttttaacgtgaaatgcgaacacctggatagcatgaacaaatctaaagaacatggatttttaggctttcgtaataccgcgaagtcttttaatgcctggattgataaaatgaaagtgctcaaaattgtgccg

SEQ ID NO: 1186 - DNA, 1158 bp, Citrus clementina
atgctggtgcaaaacaagctcgatgaaggggaacctagccgtgacaaccagcacgttgggttgatagtaggtgtgaccgggattgtaggaaattcgctcgccgaaattttaccgcagccgaacactccgggaggtccatggaaggtttatggcgtcgcacgtcgccctcgaccagcctggaatgcagaccacccgattcagtacattcaatgtgatgtcagcgatgcagatgaaacccaagcgaaactctcgaaactgaccgatgttacccacattttttatgttacgtgggcgtcgcgtcctacagaactcgaaaactgccacgtgaatggggcgatgctccgcaacgtcctgcgcagtgtaatgccgaacgcgccgaatctccgccacgtatgcctgcaaaccggtggcaaacactatttagggccgtttgattacttcgtggacacccaattgccgcatcacccacatgatccgccgtataccgaagacctcccgcggctgaacgtgccaaacttctactatgatcaggaggacattctctttgaggaagtcgcaaaacgcgacggccttacgtggagcgtacatcgaccgttaggcatttttggcttttcaccgtattctatgatgaacattgcttgtaccctttgcgtgtacgcagccatttgtaaacatgagggtgtgccattgctgttcccgggtacgaaagaagcgtgggacgggttcactgaagtgagtgatgcggatttgattgcggaacagcagatttgggcggccgttgatccgaacgcgcggaacgaggcgttcaattgcgcaaacggagacgtgtttaaatggaagcatttctggaaagtgctggcggaacgctttgaaatcgaggattatggctttgatgaaaagggcgaacgcttacgtttagtggaaattatgaaaggcaaagaatctgtttgggaggaaattgtgcgtaaaaacaagctactaccgacgaaactgaatgaagtcgccatctggtggcatgcggacgtttcctttgatgttggtgaagatatcctggttagcatgaacaaatcgaaaggccatggctttctgggtttccgtaactccaaaaacagcttcatcgcttggattgataaaatgaaacgctacaaaattgtaccg

SEQ ID NO: 1187 - DNA, 1245 bp, Panicum hallii
atgatgcgctggtgctggacaggcgcttatggcacgattgaacgccgccacattgtagcacgagcagccgccgaagcagaagcggcagcaactgcctcccagaaagtggcattggtagtaggctctaccggagtagtcggcgcagcgttactggatattttgccgagcctggatacgcccgtagggccgtggaaagtttacgcgctttctcgcgggcctttaccgccgtggtcggctcctgcaggggcgccttccagctcctacccgaaccccgtcatccacctgcatctggatttagccgatccggccgcggtggcccaagctctgaaacctttgaccgacattacccacgtattttataccgcgtggtcagcatgcccgggcgccaccgaggacgatgcccgcgaggccagttgcgcgatgttacgtaatgtgctgagtgtagttgttccgcgctgcccggcgttggttcatgtgtgtctgcagacgggtcgcaaagggtttgtggaccctttcgagcccatgagcggattctttgcggcgattgtagcgatgcgcccgtacccggaagatgtgcctcatttagagcattctgaccttgaggacgttttcttagatgaagtggcccatagctggcttaatggagccgcgggcgctatcacctggtcggtccatcgccccgcgaccttgttcggcttttccccccgtagtgagtcaaacgtgattgcgtcactctgcgtctatgccgcaatctgctgcaaagaaggggcggccctgcgttggccgggcagtctggtggcgtgggaaggttttagtgatgccagcgatgcggaactggttgcggaacacgccctgtgggccgcgttagagccgagtggcaaaaatgaaacctttaactgtaccaacggagatatttacaaatggaagaacttatggccgatgttagcagaccattttgagatggaatggagcggatacgatggcgaagataaacgctttaaattagaagaagccatggccggtaaagaggcgttatgggccgagattgtccgcgagaaaggcctggtcgaaactgagttgaatgatatcactagctggtggtttgtggatgccttaattaatgcgggcaaagaacaaattgaaaacatgaataaaagcaaagaacggggcttcttaggatttcgtaacacggtccgaagctttaatacgtggattggcaaactcaaggccgacaaaattgtgccg

SEQ ID NO: 1188 - DNA, 1155 bp, Prunus persica
atgaatttcaagctgcaacgtaaacatgaagaagatcacgaggccccgcatacgccgaaaagtgtgggcttggtgataggagtgacaggaattgtggggaatagtctagcccgaatcctcccgcaatcggatactccggggggtccgtggaaagtctatggcgtagcccgccgtcctcgtcctcattggaacagcgactatcctatggaatatatacagtgcgatattagcgatccgaaagacactgtgtcaaagcttagccgcctgacagacgtgacccacatcttctacgttacttgggcatcgcgtagcaccgaaccacagaattgtgaggcgaatgcggccatgatcagaaatgtactgcgtgttgtgattacgaacgcgccgaacctgtgtcatgtgtgtctgcaaacaggtacccgacattatttcggcccgtacgaatcgcttggtaaagtagaaccgcaggaaccgccgtgtctggaagatctgccacgcctgaatgcacctaacttttattacgccctggaagatgtcctgtttgaagaagtgggaaaaaaagaggatttgaatataacctggagcgtgcatcgcccaggaagcatctttgggttctcgccgtactcgttagtcaacattgtggcgatgctgagtgtctatgcgtcgatatgcaagcacgaaaaaaaaccgttacgcttccccggctccgaagctgcgtggaattgttatagcgatgtttctgacgcggatctgattgcggagcaacagatctgggcggccgttgatccgaacgccaaaaatgaggccttcaatgtaaataatggtgatgtttttaaatggaaacaattttggacggtattagcagaacaatttgaaattgaggaatatggttttgatgaagaaggcggtggcttctcgctgctggagatgatgaaagagaaagagggagtgtgggaagagattgtacgtgaaaatcagctggaaccgaccaaactggaggaaattggctggtggctcctggacttgtttttcagtggggaaggcctgatgacctctatgaacaaaagcaaagaacacgggtttctgggatttcgtaacagccgtaagtccttcgtgtcatggattgacaaaaataaagcttttaagattgtgccg

SEQ ID NO: 1189 - DNA, 1152 bp, Tarenaya hassleriana
atgaatacgatcgaagccccgaagaaaaagttagatgctgaaccacactaccgctcagttggcctgattattggggtgaccggcatcgtcggcaacagcctcgccggtatcctgccgttgagtgatacaagcggcgggccgtggaaggtgtatggcgtggcacgccgcccccgtcctgactggaccaccgatcaacagattcagtacattcaatgtgatgtgtctgatgcgatcgatgtacgcaccaagttgtctccgctgaccgacgtgacccacattttctacgtgacctggaccaacagggaaaccgaatcggaaaactgtagcgcgaacgcagcaatgctgcgcaatgtgctgcgtgcagttgtgcctcacgcgccgaatttgcgtcatgtttgccttcagaccggcaccaaacattatgccggtccgttcgacaatgtggcgggacgttccttccacgatagtccattcaccgaagatctgccgcgtctgtcgcttcgcaacttctattacgatcaagaagacgttttgttcgaagaagtggagaagaaagaaggcttaacttggagtgtccaccgcccaaaccgaatctttggcttctcaccttactcgctcattaacatggtcggtagcttgtgtgtatacgccgctatctgtaaacatgaaggaagccctctgatgttcccgggttcgaaagccgcttgggagggctttaccgtggcctctgatgccgacctggtagcggaacaggagatttgggcggctacagatccgtatgcgaagaacaaagccttcaactgcaacaacggcgatgtttttaaatggaaacatctgtggaagatcctggcggaaaaatttgaaattgaggaatatggctttgaagaggaagaagggcgtgaaaaagtaggtctggtgaaaatgatggagggaaaagatcgcgtttggggcgaaattgttaaggagaaagatctcgaaaaaacgaaaatggaagaaatgggcgagtggtgggtggtagatcttattctgagggtggaaggtatggtggattgcatgaataaatctaaagaacatggctttttagcattccgaaatagcaccaaatcgtttgcttactggatcgacaaatatcgagcgcataaaattgtacca

SEQ ID NO: 1190 - DNA, 1323 bp, Capsicum baccatum
atgaacgtgttggtgtgtctacgtgattggatccgtgcggaacgccgcaaccaaggtatcgagaaggaacccaatgacaaacagcgcctggaggaaattatgacgtcccgtgaaaacttagctgaatccagcctgatgcatggcttcgcacctattgattttgactatccaatgcagcagaacgtcgaatattgtggcacccatgaaatctcataccaaaatgtaggactggtgattggcattaccggtgtggtgggaaattcactggcagaaaccctgagcagtactgatacgcccgggggcccgtggaaggtgtatggcgtgtcccggcgcggcaaaccggtctgttcaattgcaaaggttcgctatattcagtgtgatgtgagcgtcagcacagacgtccagagcaaattgagcacattaaaagatgtcacacacattttctgggttacgtccgcgtttgatctttcgaccgccaaatgctgcgaaatcaatggcgcgatgttccgcaacgtgctgaacgccgttattccgaatgcgccgaatgtgtgccatatttgtctgcagaccggtgccatgcattacatggagattcagcgcagcattgatggcaaactgcacgtgatcagccatgatcctccctttaccgaagatatggaacgcctggagaacatccacaatttctattacaccttagaagacgtgctttttgatgaagtttcacgcaaaccaagcctgacgtggagcattcatcgcccggatttaatcttcggcttttctcatcactccatgctcaacatcgtgggtacgctgtgtgtctatgcgacgatttgcaagcacgagtgtattccgctaatttttccaggaacgaaagcggtgtgggattcttatagcaacgcaagcgatgcgaatctggtggcggaacatcagatatgggctgccctgggcgcgcaagggaaaaataaagcattcaatatcacgaatggcgacgtgtttaaatggaaacaactctggaaagtgcttgccgaacagattggcgtggaatatgtgggctttgatgaaaccgaaaagattatcagcctgagtgaaatgatgaaagataagggtaccgtatgggagaaaatcgtccgcgacaacaacctgatttcgacgaccctgcaagaagtgggactgtgggattttgcagacatgctgctggctggcggtacctctcgtctttgtagcattaaccgaagtaaagaacatggctttttcggcttccgcaactcgatcaacagcttcatcttctggatccaaaaagccaaagataatcgcctcattccc

SEQ ID NO: 1191 - DNA, 1170 bp, Medicago truncatula
atgaactggtggctggcacgcgcgacgggtgatcaccctggcaagattactaaattcaaagaagctccgcgcaatgtccagaacgttgctcttatcattggtgtcaccggcatcgtcggcaattcgcttgccgaaattcttcctctgaaagatacgcctgttggcccttggaaagtgtacggtgttgcccgccgcccgcgtcctatgtggaacgtagataatccggtccattatattcaatgtgacgtttccaaccagaatgatgtggaattaaaactctcgccgctgactgatgttacacacatcttttacgtgtcttggacctctcgccccaccgaagcccagaattgcgaggtgaacggggcgatgctccgtaacgtcctccaagcattaatcccaaatgcgccaaatctgagtcatgtcagcctgcagactggggctaaacactacgtgggcccgtttgaaatcataggcaaaataaaaccacacgaaagtccattcacggaagatgttccgcgcctggataccccgaacttttattataccttagaggatattctgtttgaagaagtaggcaaaaaaaaaggtacaacgtggttcattaatcgcccgcaagttattttcggcttctccccgtattccatgatgaatctgattgggacgctgtgcgtatatgcggcaatctgcaaacacgaagggcttcctctgcgttttccgggatcaaagggcgcgtgggaatgctattccaccgcctctgatgcgaaccttatttccgaacaacacatctggggcgccgtcgacccgaacgcaaaaaatgaagctttcaattgcagcaacggcgacgtgttccgttggaaacatctttggaaagtattggccgagcggtttgaaatcgacgactatggctttgaagaaggtagcgagctgcgcctgagcgatctcatgaaagacaaaggcggtgtgtgggaagagatcgtccgtgagaacgaactgttatacaccaaactggaagaagtgggtgactggtggtttgcggacttcatgtttcgtgtggaaggcgtcctggatagtatgaataaatccaaagaacacggctttctgggctttcgcaactctaaaaactcgtttatctcttggatcgataaaaccaaggcgtacaagattgtgcct

SEQ ID NO: 1192 - DNA, 1185 bp, Nicotiana sylvestris
atgaattggtggtggagccgctctaccaataccacccagcagaacgttgactattatgagacaactaatcacgagagcaaccaaaatgttggtctggtcataggcgtaacgggtgtagtcggcaacagtctggcagaaactctcagttcgaccgatagtcgcgggggcccatggaaagtatacggggtcgcccggcgcgaaacgccggttcgtaacgccaaggtaacatatatccaatgcgatgtctcagtggcgaccgacactcaggcgaaactgagtacgctggaagacgtaacccacatcttttgggttaccagcgcgttcgatctgtcgatggccaagcactgtgaaataaatgcgaccatgctgcataacgtgctgaacgccatcatttctaatgcgcctaacctccgccatatctgcctgcaaacgggcgccatgcattatatgggcatccatcgtagcgttgacggcaagattcataccattagccatgatccaccgttcaccgaagaaatggaacgcctggaaaacattcacaatttctattatacgttggaagacgtgcttctggacgagatcagtcgcaagccgtcaatcacctggagtgtgcaccgtccggatctgatctttggattcagtcctcacagcacccttaatatagttggtacactgtgcgtatacgcgacaatctgtaaatatgaacgtgtaccgctgaccttcccgggtaccaaagtcagatgggactcatatagcaatgcgtcggatgcagacttggtagcagagcaccagatttgggcggcgctgtgcccccgcgcccagaataaagcgtttaacattaccaatggcgatgtgttcaagtggaagcatctgtggaaggtgcttgccgagcaaattggagtggaatatgtgggatttaacgaaaccgaaaaacacatttgcctagccgaaatgatgaaagataaaggacatgtctgggacaaaattgtgcgtgacaataacctggtttctaccaccctggaggaagtaggtttatggcagtttgcagatatgatcctggcaggtggttcgaatcgtctgagctcgatcaatcggagcaaagagcatggtttcatgggctttcgtaactcaaccaatagcttcatcttctggattcaaaaagcgaaagacaaccgtttaattcca

SEQ ID NO: 1193 - DNA, 1098 bp, Oryza sativa
atgccgccaatgtccatgagctggtggtgggctggcgcaattggcgccgcgcgtaaacgtcacgacggtggcggaggcgaacaacagccgccgtttcgctctgtggcgcttgtagtcgggagcaccggcattgtggggaccagcttggtcgatattttacccctgccggatacccccggcgggccgtggaaagtgtacgccttgtctcgccgtccgcctccgccatggagtccgccgccgcccgcggctgtcactcacttgtgcgttgatttagcggatgcggccgccgtagcggaagcacttgcaccgcttactgacattacgcacaccggcagcaaacactatattggcccgccggaatctattggcaaactgccggtagaaaccccgttcagcgaagatatgccgcgtcatgattacccgaatttctactacgatcaggaagacgtgctgttcgacgccgttacgtcaagctccagcagctccagttctcgccgcgcagcggccgtgacgtggagcgtgcaccgacctagcttgatattcggtttctcgccgcgttcagcgatgaacgtagtatgctccctgtgtgtgtatgccgccatttgccgtaaagagcgtcgagagctgcgttggccgggtagtttaggcgcatgggaaggcttcagcaacgcgtccgatgctgatctggttgccgaacaacagatctgggcggcagtggcggacgccgccgcgaagaatgaagcattcaattgctcgaatggcgatatttataaatggaaacagctatggccggttttagccgggaaatttggcgtcgaatgggccggctacgagggagaagagcgccgtgtgggcttgacggcagcaatggccgggaaagaagcagtgtgggcggagattgtggccgaagaaaaactggtggccaccgaactgggtgaagtggcgaactggtggtttgtagacgcactctttatggacaaatgggagtttgttgacaccatgaataaatcgaaggaacacggctttctgggcttccggaatacgctgcgctcgtttgaggcgtggattgacaaaatgaaactttatcgtatcgtgccc

SEQ ID NO: 1194 - DNA, 1230 bp, Oryza sativa
atgccgcccatgagcatgtcttggtggtgggccggggctatcggcgcggcgcgcaagcgccacgacggcggagggggcgaacagcaacctccttttcggtcagttgcactggttgtgggctcaaccggcattgtggggacgagcctagtggatattctaccgttaccagacacaccaggaggcccatggaaagtgtatgccctctcacgtcgtccgccaccgccgtggagtccgccccctccggcagccgtgacccatctctgtgttgacttagcggatgccgccgcggtggcggaagcgctggcaccgttaaccgatattacgcatgtgttttacgtcgccctagcggcgccgcatctggcggaagcacgaagtcgcgaggccaatgccggtatgctgcgcaatgtgctggcggcggtggtcccgacctgccccgctctagcgcatgtggcactgcagactggctcgaagcattacattggcccgccagaatcgatcgggaaactcccggtcgagaccccgtttagcgaggacatgccgcgccatgattatccaaatttctattatgatcaggaggatgtgctgttcgatgcggttacgagttcgagctcctcgtctagctcacgacgcgccgccgcggtgacatggtctgtacatcgcccgagcctcattttcggcttttcccctcgttctgcgatgaacgtggtttgcagcctctgcgtctacgctgccatttgccgcaaagaacgacgtgaactgcgctggcctggatcgcttggggcatgggagggctttagtaatgcgtcggacgcggacctagtggccgaacagcagatctgggcagcggtagcggatgcggccgcgaaaaatgaggcgttcaactgtagcaatggcgacatctataaatggaagcaactgtggccggtcctggctggaaaatttggcgtcgaatgggccggctatgaaggcgaagagcgccgtgttggcctgacggcggcaatggcgggcaaagaagccgtctgggccgaaattgtggcggaggaaaagttggtggctaccgaattaggcgaagttgcaaattggtggtttgtggacgcgcttttcatggacaaatgggagtttgttgacaccatgaataagtccaaggaacacggctttctgggctttcgcaacaccctgcggtcttttgaggcctggattgataaaatgaagctgtatcgcatagttccg

SEQ ID NO: 1195 - DNA, 1137 bp, Cynara cardunculus
atgcgtaaacttgaagacgggaacccgagtcgaaagtatcagaaattcgcgctgataattggcgtgactggcatcgttgggaatagcctagcggaaatcctgccgctgcacgataccccggaaggtccatggaaggtatatggcgtcgcccgtcgcccgcgtccttcgtggaacgatgactatcctattgattatattcagtgcgacgtttcagatccagagcagacccagagtaaactgagcactctcaccgatctgacgcatctattttatgttacctgggccaactgtgagaccgaatccgagaattgcgatatcaacgggaaaatgttcactaatgttctgaatgcggtaatccccaacgctcccaatctgcagcacatttgtttgcagaccgggcgcaaacattatattggcagtttggaggcgattatggccaaaaagttcgtccacgatccgcccttccatgaagacctgcctcggttggatagcccgaacttttattacaccctggaagatattctcttcaaagaagtagaaaaaaaagaagggctgacctggtcaattcatcgtcctggcgtgatctttggctttagcccgaactcgatgatgaacattttacttggtctatgcgcgtacgccagcatctgcaagcacgagggtcaaccgctgaccttcccgggaacgaaagaagcgtggaattcttttaccgatgcgagtgatgccgatctaattgccgaacatcagatttgggccgccgttgatccaatcgcgaaaaacgaggcgtttaacataagtaacggcgacgtgtttaaatggaaacacctatggaagatcctggcggagcagtttgaagttgaaaacgggggattccgagaagatggcgaaaagaaaagcctgggtgagatgatgaaagacaaaggtggagtctgggacgaaatcgttaaagagaaaggtctgctggttaacaaacttgaggaggtcggcaaatggtggttcgtggatgttgtgctgtccaacgaagggatgctagacatcatgaacaaatccaaagagcatggatttctgggattccgaaataccaagagttgtttcgtgtcatggatcgataaaattaaatgcagtaaaattgtcccg

SEQ ID NO: 1196 - DNA, 1173 bp, Ornithogalum longebracteatum
atgcgctggtggtgggcaggtgccataggagcggctaaacgttcgatggattccaccccgccgcagggccctacctatcagtcggtagcgttagtagttggcgcaaccggtatcgtgggttcgtcgttaattgacattcttcctctgagtgacacaccgggcggaccgtggaaactttatgccattagccgtcgtcccctggatagcagttcaccatctgtcgtacacgttcagtgcgacgtagcggatcctgatgaaacgttagcgatgttgtccccgctgtcggacgttacccacgttttttatgcagcctgggctcaccgcccgagcgaacatgataacattacggttaactctgcgatgcttcgtaatgtcctggccgcagttgttccgaatgccccgaatttacagcatgtgtgcctgcaaaccggcagaaagcattatgtcggctcttttgaatatctagggaagatccaggggcacgagccgcctttccatgaagacttgccgcgcttagacagcccaaacttctactataatcaagaagatatccttttcgaggaaagtgaaaaaaccgacggtcgcgtgtcctggtcggtccatcgtccaaccactatctttgggttttcggccatctcgaaaatgaacattatgcagtccctttgcatttatgcggctatatgtcgcaaagaacgtgcgctgctgcgctggcccggctcacgcgtgacgtgggaaggcttctctgatgcgtccgacgcggacttaatcgcggaacaccagatctgggcggccgttgatccttacgcgaagaatgaagcgtttaattgttcgaatggtgatgtttttaagtggaaacaactttggcgtactcttgcggaacaattcgaagtagggtttgtcggctatgaaggcgaagaaggccgatttagcctggaagaagcgatgcgcggaaaagaagaggtctgggcagaaatcgtacgtgaaagtgaactcgtcgaaactcgcctggaagatgtgggcaattggtggttcgtagacgctgttttaggtgttgaattcgaacatctcgatactatgaacaaatctaaagagcatggattcttgggtttccgcaataccatgaatagctttatttcttggattgataagatgcgagcgtttaaaatcgttccg

SEQ ID NO: 1197 - DNA, 1191 bp, Allium ursinum
atgcgttggtggtgggccggcgccattggggccgcgcgtaaaaccctcgactcaagcagcgcaagcaactcaaacacctccattccaccccctcaaagtatcgcgctcgtgattggcgctaccggaatcgtaggcaccagcttgctggacatcttgccgctggcagatactccgggcggcccgtggaagctgtatgcagtttcacggcgccccttagtatccgataacccgaaagttcatcccgttcagtgcgatatatctgacagtgcacagacattagaacgtcttagtccactgtcggatgtgacacacattttttatgtagcgctggcgcagtgccccacggaagccgagaacatcgccgccaactcggccatgctgcgtaatgtcctgaattcagttatcccaaacgccccgaatctgcagcatatctgcctgcagactggccgcaatcattattcgggcgcatttgaatttgcaggcaaagtgaagccacacgatccgcctttttatgaagagatgctgcgcttgaatagcccgaatttctactataatatggaggacattctcttggaagaagtggagaagcgcgacggcgtaagatgccacggctctgttcatcgtccgaccattatcttcggtttttcaacccgtgcggctatgaatattgtgcaaggggtgtgcgtgtacgccgcgatttgcaaaaatggtgggaaagcgttacgctggcctggaagccgcgttacgtgggaaggtttctcggatgcgtcagatgccgatctggtggccgagcaccagatttgggcggcggtcgacccgtacgcgaaagatgaagcgtttaactgcagcaatggcgacgttttcacgtggaagcagttgtggaaagcgctggcggaacagttcgagctcgaatgggtcggctatgagggcgaagataaatcatttagtttggaaaaagaaatgcgtggcaaggaagccgtgtggaaggaactggtgcgagaaaacgaactagtggataccaaattggaggaagtaggaaactggtggtttctggacctcgtactgggcgcggaaatcgaacatctggattcaatgaataaatcaaaggaacatggatttcttggttttcgtaatacgttaaatagcttcaactcatgggtcgataaaatgaaagccttcaagattgtgccg

SEQ ID NO: 1198 - DNA, 1194 bp, Convallaria majalis
atgcgatggtggtgggcaggcgcggtcggtgcggcccgtaaaaaaatcgatgacggccccccggcggcgccgaagtttcaaagcgtcggtctgatcataggtgatatcggcctagtaggtaactcattggcggaaattctgccgttaagtgatacgccggggggcccatggaaggtctacggtgtcagtcgtggcccgaagccgccaccgagcgacccgcctacgtttggcagctttgatcatgttgcctgcgatgtgtcaaacctggaccgcacgctggaaaagttgagcccgttggccgccgatgttactcatttattttacgtgggcgatgatgaagaatccgatccgaccgctaattcctcgatgtttcgcaatgtccttgaggcagtacttccgagtgcccctaacctgcagcatatttgtctgctgaccggattggaacattatctaggcccgctggaagcctgggggaaaatcccggcgcatgatccgccgtttcgtgaagatctgccacgtcttgatgcgcccaattactgctatgatttggaagatgtgctcttagagagcgtgaaagacgaatggggcggccggggcacgtggtttggccccccggcccctcctcatagcatcttcggcttctccaccaagtgcagtatgaacctaatcggcaccctatgtgtttatgcgtccatttgtcgcaaagagaaggtgcctatgcgctacggccctggcaaccgcgtccaatgggagggcttcagcgaagcctcagatgcagacttagtggctgaacatcagatttgggccgccgtcgatccgtacgctaaaaatgaagcgtttaactgcaacaacggcgatgttttcaaatggaaacatatgtggaaagtcttagcggaacagttcggcgtagagtttgtaggttatgaaggagaagatggcgaacgggcgcgcctggccgacgcaatgaaaggcaaggaggaagtgtgggaagaaattgtgcgggaaaacgaacttgttccgactaagttagaagttgtgggtaactgggaattcgtcgacacgatgctgaacgccgaggattcgtatctgtcatccatgaataaatcaaaagaacatggttttctgggctttaggaattcagtcagcagctttatcagctggattgacaaggcgaaagcgttcaaaattgtgccg

SEQ ID NO: 1199 - DNA, 1173 bp, Populus trichocarpa
atgtcctgctggtgggcaggcgcgttggggaataatcgtaaaaaattctacgacgacgatgaagcgtcgcgtgactataaatcggtagccttggttgtaggggtgaccggcatcgttggcaactcgctggcggaaattctgccattagcggatacaccaggtggcccatggaaagtgtatggagtggcgcgtggaaaacgcccaaattggaatgaggataacccggtggagtacattcaatgtgatatcagtgaccgcaaccagacgcagtcaaaactgtctctgctgacagatgtgactcatatcttttatgtgacttgggcaaaccgagaaacggaatcggaaaattgcaaaatcaacggtttgatgttccgtaacgtactggaagccgttattttgaatgcccacaatttacgccacatctgtctgcagaccggcaccaaacattatgtaggtccgtttcaattcttcggcaagatcgaggctcatgatccaccctttaccgaagatctgccccgcctcgaatttccgaatttctactacaccttggaagatattctttttcaggaagtcgcgaaaaaagaaggcctgacctggtctgtgcaccgtccagataacatttttggtttttccccgcactcattgatgagtattgtgcgcacactttgcgtttacgcggcgatttgcaagcatgaaggcacactgatgcgctttcccggagtgaaagaagtgtggaactgttatgccattgcgagcgacgcagacctaattgcagagcatgaaatttgggcctgtgtggatccgtcagcaaaaaatgaggcctttaatatccacaacggtgacgtgttcaaatggaagcatctctggaaagtgctgggcgaacaattcggcctagaagaatatggtttcgtggaaactgaagaacgcatttccctggcggaaaccatgaaagaaaaaggcgcggtttgggaagaaatcgtgagagaaaatcagcttcttccgaccaaactggaagaagtcggcgcgtggtggttcgtcgatctgatctttggcggcgaagtgagcattccgagtatgaacaagagcaaagaacatggcttcttagggtttcgcaacagcaaaaagtcgttcatatcatggattgaaaaaatgaaagcttccaaagtggtcccg

SEQ ID NO: 1200 - DNA, 1224 bp, Sorghum bicolor
atgtcgctcccgccccatctacatttcgattttgatcaagagcttgaacacaaaatggagtgcgaaggcacgaaaaaagttgttctagttattggtagtaccggtatcgtgggctccgcattaattaaccttctcttgctggagaatccaaagaatccggtcggttcctgtaaaaaagtgtatgccctgagcagacgaccgatgccaccgtggtatatgactgcgagctcatcgagcttcagcagtaacaacgacccgatccctacggttatccatctccatgttgatttggcggatgacgcggcagttactaaagcgctggcgcccctcaccgacattacccacgttttttacgttacctgggcgccgcgtcatggctggagtaatacggaagctcataccgttaaccgtgcgatgctctcgtctgtcctctcggctgtaatcccgaacgctccagatctaaaacacgttgccttgcagtctggccgcaatcagagcgctgatccgttccagcctccggtgcgcggtgcgttcgctgaagatggttggttaggcccgttcagtgaagatttaccgcgcccggattatccagatcttgaggacgcgttaatcgatggcatagcctcgagagtgggtgatgtgacttggtcggtgcatcgtccggccacgattttaggattctcaccgcgttcaagccgaaatctagtcagctcgctgtgtgtctacgccgcaatctgctctaaagaaggcgccgtcctgcgttggccggggtcgttagtggcatgggagggcttctccgacgcatgcgatgcgtggcttattgcagtgcaggcaatttgggcggccatgatggcccgtccaaatgaggcatttaattgcgggaacggcgatgtgttcaagtggaagcagctatggcccattctggcgagttacttcggggtcccatgggcaggatacgaaggtgaggaccaacgatttaaactggaagaagcgatggtcggcaaggaaccggtatgggcagaaatcattaatgaaaacggcctggtagaaacggagttagatgacatcaccacctggtggttggtagacgcagttgtgaacgcggaaaaggaacatgtggagaccatgaacaagtcgaaagaatttggatttcatagtatttatgatacggtgcgttgctttgacacatgtatccgcaaaatgaaagcgagtcggattgtcccg

SEQ ID NO: 1201 - DNA, 1203 bp, Zea mays
atgagtctgagttggtggtggacccgcagtgttggagccgaccgtgaacgcaaagacgaattagccgcagttccggaacacagtttccaatccgtagcattagttgtcggaagcacaggcattgtgggtgcgagcctggttgatatcatcccgcgagcggatacgccaggcggcccgtggaaagtttacgctttgtctcgccgtccgcctccgccgtggagcttgccgtcatcatcttccttaacacatatcaacgtggatttgaccgattcggcgaccgttgctgaagccctcacccccctgactgacattacacatgttttttatgtcgcctggtctccccgtgcgaccgaagctgaaaaccgcgaagcgaacagtgcaatgttaaggaatgtgttaagcgttgtggtgccgaactgtccggctctggcgcatgtgagtctgcaaacaggtatcaaacactacctgggccccttcgaacttatcggtaaaattccaactccagacccgccgtacactgaagatgtcccgcgtctggattgccctaatttctactacgatcaggaagatgtgctattcgcggcggtatcacgacgaggtggagcagtgagctggtctgttcatcgtcctaacctgattctgggctttagccctcgctctttttttaacgttgtttgtagtctctgtgtatatgctagcatttgccgcaaagaaggtgtcgccctgcgttggccgggatgcctaggatcttgggaatcattttcaaatgcaagcgacgcggatttgatagccgaacagcacatctgggcggctgttgaccccatggcaaaaaaccaggcgttcaactgtaataacggcgatctttataattggaaaatgttgtggcctgttctggcggcgcgcttcgggctagaatggacgggttatgacggggaagaaaaacagtttaaagtgtcggaagccatggccgggaaggaagcggtgtgggcggagatcgtacgcgaaaacggtcttgtagaaacccgcctatacgatgtggcggattggtggttcattgacttcgttgtgtatgaacactcagcggattccaaactcctagacagtatgaataagtctaaggaacacggctttctgggctttcgggataccgtgaaatcgttcggcaaatggatcgataaaatgaaggcatacaaaattattccg

SEQ ID NO: 1202 - DNA, 1161 bp, Daucus carota
atgtcactgtggtggtctggtgcggtcgccgccgccaagaaacgtatgggccagttagagtatgcctcagccccttctcgctacaacagcgtggcgttagtagtgggtgtaacggggatcgttggtaatagccttgccgagatcttaccgctgtcagatactccgggtggtccgtggaaagtgtacggggtggcccgccgcccgcgcccgccgtggaaggtggacgaacgggtggattacatccagtgtgacatctgcgacctggacgaaacgcgcctgaagttatcaatgctgcaagatattacacatgttttttatgtcacctgggccaatcgtcctaacgagagcgaaaactgcgaaatcaacggcaagatgctacgtaatgtcttaaatgcgctgattccgaatagtcccaacttgaaacatatttgcctgcagaccggtcgcaaacattatgtggcacctggctctgaagatcatgatccgccttataccgaggatctgccccgtttagactcaccgaacttttattatattctagaagatatccttttcgagcaggtggggaaaaaagaaggattgacttggtcagtccaccgcccggcgccaatctttgggttcagcccttactccctcatgaacatcataggcaccctgtgcgtatacgcgaccatttgcaaacatgaaggcgtgccgatgcgttttccgggtaccgaagaagcctggaactgttactcggatgcaagcgatgctgatttaatcgcggaacatcagatctgggcggcagtcgatccgtacgccaaaaatgaggcctttaactgtagcaatggcgatgtgttccgttggaaacatttttggaaagtgcttggtcagcaattcgaggtcgaatgcggctacttagaagctggcgagcgtcttagcctggcagaaatgatgaaagataagggaccagtttgggataaaattgtgaaggaaaagggcttagtacctactaaattggaagaagtcgcggcctggtggtttgcagacggcatgttctccggcccttgcccgcttattagcatgaataaaagcaaagaacacggtttctttggatttcgcaacagtaaatcttgctttatttattggatcgataaaatgcgtagttatcgtgtcgtcccc

SEQ ID NO: 1203 - DNA, 1191 bp, Nepeta cataria
atgtctatgaactggtggcgtgacggcgccgctaaaaaacgtatggacgagtcgtctgccgtgaaattacaacagcaacaatgcgtggcgctgatcgtgggcgtcaccggacttgtcggcaattcgttagcagaaatgttgccgctctcagacaccccaggaggtccttggaaagtgtacggtgtcgcacggcgcccgcgcccgtcttggaatgaagatcatcctatcaattatatttcgtgcgatgtgtctaatacggccgaagttgaggcgaaacttccccccctgagcgatgtaactcatattttttacgcgacctggacaagccgctcctcggaggaggaaaactgcgaagcgaacggcaaaatgctgaagaatgtgctggataccatgattccgaattgcccgaaccttaaacacatttgtttgcagactggccgcttccattacgtggcgtcggtggtggattggaaaattaacggtagccacgacaccccgctaaccgaagacttaccccgtcttaataccaacaacttctattacacacaagaagatatccttttagaagaagtaaaacgcaaagaagggttgacctggtcggtgcatcgccctggcacgatttttggctttagcccctacagcatgatgaacctggtaggtaccttatgcgtgtatgcagcgatctgcaagcaagaaggtgcggtgctgcgcttccccggttgtaagggcgcgtgggacggctatagtgactgcgcggacgcagatttgattgccgagcactatatatgggccgcgcttgatccccatgccaaaaatcagagctttaatgtgtcgaacggcgatgtttttaagtggaagcatctgtggaaagtattagctgaacagttcggcgtagagtgcgggggctacgaatatgaggaaggtcaacaagtacgcttacaggatgtgatgaaagataaaggccctgtgtgggataaaattgtacgcgaaaatggcctgagcaatactaagctggaagacgtggggaaatggtggttcagtgataccattctgtggaatgaatgccgtctggacagcatgaataaatcaaaggagcatggtttcctgggcttccgcaatagcaaaaattgcttcttgtactggattcacaaactaaaagcatataaaattgtgccatcgagcaccatttca

SEQ ID NO: 1204 - DNA, 1182 bp, Catharanthus roseus
atgtctatgcgctggtggtgggcaggcggcgcaataggtgccgcgaagaagaagctgcaggttgacgacggcccaccgaaacaccagagtgtagggctgatcctgggagtaacgggccttgtaggaaattcgctggcggaaatcctgccgttgagcgacactccgggcggcccgtggaaagtatacggtgttgcacggcgtagccgcccaacctggcatgcagaccatccaatagagtatatccaatgcgacttaagtaatccggaagaaacggagtctaaattatcgaatttaaccgacgtaacacatattttttacgtaacctgcgtaacagcaaacaaatataccgatgcagaaaactgcgatgcaaacggtaaaatgtttcgcaacgttttaaacgccatcatcccgaattgcccgaacttacaacatatctgcctgcagactgggctgaaacattattttggccgctcgctggttggcaactttgtgtgccacgagagcccttgttatgaagatctgccgcgtttggatgttcccaatttctattatacactcgaggatatcctctatgaagaagtgcaaaaaaaagaaggtctcacctggtccgtgcatcggccgggcaccatattcgtgttctctccattttcgtccatgaatctggttggcacgctgtgcgtttatgctgccatttgtaaacagcaaggtctgccgctgaaattcccagggagtaaaaatgtgtgggaaggctattcaatgtgctccgatgcggatcttgtggcggagcaacagatttgggccgccattgaccatttgcctaatgcgaaaaacgaggcctttaatgtatcaaacggcgatgtttttaagtggaaatacatttggaaagtgctggcggagcagtttggtttggaatttgtggaattcgacggcgagaaattatccttgcaggaaatgatgattgacaaaggtcctatttgggaggaaatcgtgcgtgaaaacggtctgttgggtacgaaactggaacaggttggcgtttggtggttcgcggacgtcctgctgggcttcgaatttccgcttgatagtatgaataaatcgaaggagcacggcttcctggggttccgcaatagcaaaaatagcttcctgtcttggatcgagaaaacgaaagcctataaaatcgtaccg

SEQ ID NO: 1205 - DNA, 1203 bp, Dichanthelium oligosanthes
atgagtatgtcttggtggtgggcaggagcgattggtgcggtttcgaaacgtcaggacgatcatgcagcggtgtctccgtcacagcacggcttccagagcgttgcagtggtggttggcagcaccggcatcgtgggaaccagcctggtggatattttacctctgccggatacccctggcggcccatggaaggtttacgccttatcacgccgccctctgcctccgtggagccttgcaagctcccctagctcagttacacatattcatgttgacctgaccgattcggcggcggcgacggaagccttgacccctcttaccgacattacccatgtgttctatgtggcgtggacctggagagcgactgaggaagaaaattgcgaagccaactctgccatgcttcgcaacgtgctgagcgtggtcgtgccgaattgtccaagcctggtgcacgtgaccctgcagacgggcactcgccactattttggccgctattctgaaaatccggttcacgataccccgtacaccgaagatatgccgcgtctcgacatgccagtgttttactacgatcaggaggatgttctctttgatgcggttgagcgcagaggtaaaacagttagctggtcggtccaccgcccgaacattatttttggcttcagcccgcgctgcgcgatcaatttggtgtgctcgctgtgcgtatatgcggctatttgccgcaaagaaggcgccccgctgcgttggcctgggagctgcggcggttgggagggattcataacaccgtcggatgccgacctcgttgctgaacaccacatttgggccggcgtggaaccgatggccaaaaacgaagcattcaactgttcgaacggtgatgtctgcacctggaaaaaactgtggccgatcctcgcgggccgctttggcctggaatgggccggctacgaaggtgaagaaaatcgtttcaaattgaccgaagcgatggcgggcaaagaagaactttgggccgaaattgtagaagaaaacgagcttgtcgcgacacatgttagcgaagttgcgaattggtgggttattgagacaagcgcggatcaatatggccttaattctccgatccttgattcgatgaacaaatcaaaagaacatggatttctgggattccggaacacgttcaagagttttaacgcgtgcattgatcgcctcaaggcccaccgcatcgtcccc

SEQ ID NO: 1206 - DNA, 1239 bp, Sorghum bicolor
atgtctatgtcatggtggtggcgcggcgcgattggtgcgacgcgtcgccgccaggatgaacacgctacagcgacgacggaacgccgaccctttcagtcagttgctttggtcgtgggctgcacgggtatcgtgggggcttcactcgtggatattcttccgttgcccgatactccgggtgggccttggaaagtctacgcgctgtctcgccgtccgcttccaccgtggtggcagtatcgccatccgcccagttcgtcgagcagcgtggtgactcatctgcaggttgatttgacggactccgcagcggtggcgaaaaccctgacacctttgaccgatattacacacgtattttacgcagcgctgagtgccccatccaccgtagatgaagccaaaaatcgtgaagcgaatagcgcgatgttacggagtgtactggccgcagtagtaccaaattgtccgcgcctgcgtcacgtctgccttcagacggggacgaagcattacatgggcccaccggcatcatttgggcgtcgtaccacggcgcacgaccctccgtacacggaggatatgccgcgactggattggccgaatttttattacgatcaggaagacgtgttgctggatgcagttgcggccggagcgggcgcagtaacctggtctgtccaccggcccagcctggtttttggatttagcccacgttctgccatgaatgttgtatgctcactctgtgtttatgcagcaatctgccgaaaggatggcgtgccactacagtggccgggcagcctgggcgcctgggagggcttcagcaacgcgtcagatgcggatctggtcgcggaacaacaggtctgggccgccgtagtggatcacccgatgggaatggcaaagaacgaagccttcaactgttcgaacggcgatgttttccgctggcgtcagctgtggcctattctggcaggtcgctttggcgtcgaatgggcgggttaccgcggcgaagaaaaccgcgtgaagttagttgacgcgatggccggcaaagagccggtatgggccgaaatagtggaagaatcccaacttgtcccgacgcagctgcacgaagtagcgaattggtggtttgtcgacgccttattttgcgcgaaatgggaatttctcgacagtatgaataaatctaaagaacacggttttctgggcttccgcaacactgccaagtcgtttgacaactggatcgataaaatgaaagcatgcaaaattgtcccc

SEQ ID NO: 1207 - DNA, 1140 bp, Tarenaya hassleriana
atgagccgccagatttaccataaaaatgttgcgcttataatcggtgttacggggctcgtgggcaattctctgagtgaaattctcttaaaaccggaaactaacggtggcccttggaaggtctatggcgtggcccgtcggccgcgtccgcggtggaattcagattgtcggattgaatatattcaatgtgacgttagtgacgcggagactacccgtcgcaaactgagctgtctgaccgatgtgacccacgtgttttacgtgacctgggctagccgtgaaacggaagcagaatgctgtgatgctaacgcagcaatgcttcgtcatgttctgacggcggtggcaccgtccttgcgccacgttgtacttcagacgggtaccaaacagtatgtagggccatatgaaagcttaggccgtattcggacgcatgaaccgccgtttagcgaagaccttcctcgcctgccgtatccgaacttttattatgcgcttgaagatgtgctctgtcaggaactggaaaaaacggaccagagcgtcagttggtcagtgcaccgcccgaatgtggtctttggcttctcaccatatagcctagcgaatatcgttttcagtttttgtatttatgctgccgtgtgcaaacatgaaggggtgcccatgtacttcccgttatcaaagaccacctgggagtgttacagcgttgcatcagacgcggacttgatcgccgagcaggaaatatgggccgcgatggaagcatcctgcaaaaacgaggctttcaattgcagcaatggagatgtgtttaagtggaaacaactttggggtatccttgctgagtcgttcggcatcgaagaatacggctttgaagaggggaaaaacctgggtctagttgagatgatgaaagacaaaggcaacgcctggcgtgaaattgtagagaagcatggtctggaagagacagagctagacgacggtatcgttggcagctggaaaatcgtagatgcggtcatggctgagggtggtcttctagattgtatgaaaggggatggtattttagattcaatgaacaagtctaaagaatttggatttctgagctttaggaactcaaagaagagttttgtccactggattagcaaatataaggaccataaaattgtacct

SEQ ID NO: 1208 - DNA, 1275 bp, Citrus sinensis
atgtctcgccgttggtgggcgggtgcggtggacgcgcctaaaaaacaaaaaccgaacctgagcagcatcttccaaaaccatcagaaaaagagctggagctggtcatggagctgggctagtgacatcggtgcgcccaagaaaaaactagacgaggataagcgcccacgtgattaccagctggtgggcctgattttaggtgtgacgggcatcgtaggtaacagcttagcggaaattttacctcgtagcgatacgccgggggggccgtggaaagtctatggcgttgcgcgccgcccacgtccggattggaacgcaaaccacccaattgaatatattcaatgtgatattagcgatcaagaagaaacgcaggccaaactgtccaaacttaccgacgtgacacacatcttttatgtgacctgggcgagccgccctactgaagttgagaactgtcagatcaatggttccatgtttcgcaacgtcctgcgctcaatcattcctaacgcaccgaatctgcgccatatttgcctccaaacaggcggaaaacactacttagggccgtttgactgtatcggtaaaattccgtacgatccgccgtttaccgaggacttaccccgtctgaacattccattattttattacaaccaggaggatatcctgttcgaagaggtggagaaacgcgaaggtttgacctggtcaattcaccgcccatttggtatcttcggtttctctccttactcgctgatgaatattattgcaaccctgtgtatgtacgcagccatctgcaagcatgaaggcattccgctgctgtttccaggtactaaagaaacatgggaggggttttcagaatatagtgacgcggatctgattgcggaacaacagatttgggcggctgttgacgcgaatgctcgaaatgaagcgtttaattgcactaatggtgatgtgttcaaatggaaacacctgtggaaagccctggcagaacagttcgagattgaaaattatggctttggcgatgaaaaagattcagaacgtatgcgcctgggcgaatttatgaaaggcaaagaaagcgtgtgggaagaaatcgtacgggagaaccagttgcagccgaccaaactgaacgaagttgccgtgtggagctatgccgacatgggcctgaacattggcgcgggatacctagtcagcatgaataaatcgaaagagcatggtttcctgggcttccgtaatagtaagaatagctttgtcacctggataggccgactgaaaagccatcggattgtacct

SEQ ID NO: 1209 - DNA, 1197 bp, Picea sitchensis
atgagtagttttagttggtgggcgggcagcctgggtcatggagtacgcaaatttgaaacgaaaggtgaatccagcgaggataaatctgaaaaacaacagggggttgccttggttattggcgtgacgggcatcgtgggtaactcgctagtggaaatcttaccgttaagcgataccccgggcggcccatggaaaatttacggcgtagcacgcaggccaaaaccggattggagcccggacaccccggtggaatacattcagtgcgacgtgctcgatcgcaagctaacgttagaaaaaattagccctctcaaagatgttacccacttattttgggtagtgtgggtgtcgcgggaaactgaagaacagaactgcgaagataacggtcgtatgctgagcaacgttttagatgccctcttgccaaacgcggagaatttgcagcacatttgcctgcagacaggcgcaaaacattacctgggaccgttcgatgcggtggcgcgtaatagatattttcagccgcatgaagccccataccatgaagaactgccccgtttgccggtaccgaacttttactatactttagaagacatcgtattcgaggcggccaaaaagaaagatggtctgacgtggtcgattcatcgcccatcatttatctttgggtttagtccatggagcctgatgaacattctgggtactctttgtgtgtacgcagcgatctgtaaacatgagggtctgccttttaaatatccaggtaatcgtattacctgggaacagtttgtggatattagcgatgcggaacttattgcagaacaggaaatttgggcagcgacctaccctcacgccaaaaaccaggcgtttaattgttcgaacggggacgttctgaaatggaaacgcctttggggcattattgcggaaaagttcgatctggagccgttaccttataaaggagaaggctttagccttgctgaagcaatgaaggataagggcccggtgtgggacgcgctggtacgcgaaaacaaactgcatccgacgaaaatagaggaagtggggaattggtggttcgcagattttacgctcaacctgcctcaggagacggtccatagtatgaacaaatcaaaggaatatggctttttcggctttcgaaacactgagacctcgcttggtcagtggatcgataagatgaaagcgagcaatgttgtcccg

SEQ ID NO: 1210 - DNA, 1017 bp, Cajanus cajan
atgagtgtgggtctggttattggggttaccggtattgtgggcaatagtttggccgaaattctgccgctggccgatacgccaggcggtccgtggaaagtttatggtgtggcacgccgcccgcggccgccgtggaatgcggatcatcctgtcgagtacatccagtgcgatgtctcggatccagcggatgcagacgctaaactggcggccctgtcagatgtaacccacgtgtttttcgtctcatggactaatagaccgactgagagcgaaaactcagaagttaacggtgccatgttacgaaacgtattgcgcgctgtcattccgaacgctcctaacttgcgtcatgttagcttacaaaccggcacaaagcactacctgggtccttttgaactgattggaaaaattgagtcgcatgagcctccattcactgaagatttgccgcgacttgacgcaccgaacttttactacacgcaggaagatattctgtttgatgaagtaagcaaaaaggagggcttgacatggagcgtgcaccgcccgcagaccattttcggttttagtccgtattcgcttatgaacgtggtgggaaccctgtgcgtgtatgcagctatttgtaaacatgagggtgtgccgctgcgttttccgggtacgcgtagcgcctgggaaggctacagctgctgttcggatgccgatctaatcgccgaacagcacatttgggcggcggtagacccttatgcacgtaacgaggcttttaactgtagcaatggtgatgtattccgctggaagcatctgtggaaagtactggccgaacagtttggtatcgaagatgaaaaccaattactgcccacaaacttagacgaagtaggcctgtggtggttcgttgacgttatttttagcgtcgagggaatgggactcttagacagcatgaacaaggcaaaagaacatggttttctgggcttccgcaacagcaaaaacagctttgtgtcttggattgacaaaacgaaagcatataaaattgtgccg

SEQ ID NO: 1211 - DNA, 1032 bp, Citrus clementina
atgtcatggttctgggctggtgctattggcgccgccaagaacgtcggcctggtgattggcgttactggcattgttggcaactctctggccgaaatcctgctgcgttcagataccccagtgggaccgtggaaagtttatggtgttgctcgccatcctcgcccgaactggaatgatgactatccggtggagtacattcagtgcgatgtctcagaccaagaggatacacaggcgaagctgagcaaacttacggatataacccacattttttacgtcacttgggccagccggcgtacggaagcagaaaactgccaaattaatggggccatgttccataacgttttaagctccgtgatcccgaacgccccgaacctgcgtcacatctgtctccagaccggcggcaaacactacgtaggccctttcgaatttgtcggaaaaattccgagtcacgatccaccctttaccgaagatctgccgcgtctcaacgtgactttattttactacacccttgaggatatcctgttcaaagagatagataaacgggagggtttaacttggtccgtccatcgtccgcacggcatcttcggcttctcgccgtatagcctcatgaacattaccgccaccctttgcgttaaattctgggccgcggtagatccaaacgcgcgtaacgaagcgtttaactgcacgaatggggacgtgctgaaatggaagcacctgtggaaagtgctggccgagcagtttgaaattgagaattatggactggaagacggtaaatgtagcgaacgtgtacgcctggaggagatcatgaaaggtaaagagagcgtatgggaagagattgtccgcgaaaatcagctgcagcccactaaactcaacgaggtggcagtctggtcatatgccgacaccgtcatgaatgttggcgccggatacttggtttccatgaacaaatcgaaagagcatggctttcttggcttccgcaactcgattagcagctttgttacctggattggccggctgaaatcgcacaaaatcgtaccg

SEQ ID NO: 1212 - DNA, 1167 bp, Aquilegia coerulea
atgagctggcgctggtcaggcgcgaatggcgcggcgaaaaataaacttgaagaggatgaagttccgagtaactaccagtcagttggtttggtaattggtgtaactggcatcaccggcaactctttggcaaaaattttgccgctgagcgagacccctggagggccgtggaaggtgtacggagttgcccgtcgtccgcgtccgacctggaataccgagtatccgattgagtatatacagtgtgacattaccaacaaagacgaaacgctgctgaagctgtctagcttaacggatatcacccacattttctacgtagcatggaccccgtgccctacggacgccgaaaattgccaagtaaacagcaaaatgctgcgcaatgtgttgcaggcagtagtcccgaatgcgcctaacctgaaacatatctgcctccagacgggcatcaaacactatacgggcgactttgaatcctttgggaaaaacctcgcgcacgatgctccgttttgcgaggacctcccgcgtctggacaccccgaacttctattatacccaggaggatatcctgttcgaagaaattgataataaagaaggtctcacctggtcaattcaccgaccagcactgatcttcggcttttctccgtacagcttgatgaacgttattggtaccctgtgtgtatatgcagcgatctgcaaacacgaaggcaagaaattacagtttcctggtccccgtgcagcgttcgagggttatttcgatgcatcggatgcggacctcattgcggaacatcagatttgggcaagcgtggcagatcaacatgccaaaaacgaggcctttaactgcacgaacggtgatgtttttcaatggaaacacctgtggaaggtgctgggcgaacagtttggcatcgaatgtgccgaattcgaagagggcgtgagtttgcaggaactgatgaaggacaaaggcccggtatgggatgaaattgtgaaagaaaacaaactctgtccaaccaaattggaagaggtgggtgcatggtgggtcgtagatacctttttcagctggaaagaattgggccttagcagcatgaacaagtcgaaagaacacggtttttttggttttcgaaactctaccacttcgttcattagctggattgacaaaatgaaggtttacaagatagtgccg

SEQ ID NO: 1213 - DNA, 1164 bp, Lonicera japonica
atgtcctggtggtgtaaatggagtattggcgccggcaagaacctgccgaaccagaacaaagaaaacggcgtatgtaaatcctataagagtgtggccctggtggtgggtgtaactggcattgtaggaagctcactggcggaagtgttgaagttaccggacacacccggtggtccatggaaagtttatggtgtggcccgacggccgtgcccggtctggcttgccaagaaaccggtggagtatatacagtgcgacgtgagcaataaccaagaaacaattagcaagttatcaccgttaaaagatatcacccatatattctacgtttcgtggataggcagcgaggattgccagacgaacgccactatgttcaaaaatatcctaaacagtgtaatccccaatgcttcaaatctgcaacatgtttgtcttcagacgggtatcaaacactactttgggatcttcgaggaaggaagcaaagtcgtaccccatgactcgcctttcaccgaagatctgccgcgtttgaatgtccagaacttctatcatgatttagaagacattctttacgaggaaaccggcaaaaataatctgacctggtcagtgcatcgtccggcacttgtgttcggctttagcccgtgttccatgatgaatatcgtgtctacactgtgtgtgtacgcaactatctgcaaacacgaaaataaggccctggtttacccgggatcgaaaaactcgtggaattgctacgccgatgcggtggacgctgacctggtagcggaacatgagatttgggctgccgttgacccgaaggcaaaaaatcaagtgctgaactgtaataacggcgacgtatttaaatggaagcacatttggaaaaaactcgccgaagaattcggcattgaaatggtgggctacgtggaaggcaaagagcaggtttccctcgcggaattaatgaaagacaaagatcaggtgtgggatgaaatagtgaaaaaaaacaacttagtaccaacgaagctgaaagagattgcggctttctggtttgcggacatcgcgttttgctcggaaaatctcatttcctccatgaataaaagcaaagaattgggctttctgggttttcgtaactcaatgaaaagctttgtctcgtgcatcgataaaatgcgtgattatcgtttcattctg

SEQ ID NO: 1214 - DNA, 1176 bp, Olea europaea
atgagttggtggtttaatcgctcggtcaatggatgcaaacagaaaaaaattcaggagaacggagttcaacaacagcaaaatggcgatattcagagcttcaaaagtgttgccctgatcgtaggtgtaaccggcattgtggggagttcgctgtctgaaatcttacagtataccgacacaccagggggtccctggaaagtgtacggcgtggcccgtcgaccgcgcccaacgtggttggccaaatctcatgtagagtacgttcaatgcgacgtgaccaacactgaagaaaccatttccaaaattagtcccttaaccgatattacccacatcttctatgtgtcttggatgggcaacgaggattgcagcatgaatgcggtaatgtttcaaaatattcttaacagtgtaattccgaacgccccaaacctgcagcatatatgtctgcagacaggctcaaaacattatattggcctgtttgaaacggatacgcctgagtcgcacgacactccgtattcggaagatctggcccgtttaaaacagccgaacttttaccataatcttgaggacatcctattcgaagaaacggctaagaaaggtttaacgtggtcggtgcatcgcccagcactaatttttggtttttcgccgtgtagtcttatgaacattgtctcgaccctgtcagtctacgcggccatctgcaaacatgaaaataagccgctggtttatcctggcagcaaagccagctggaactgcttcgtggatgccgcggatgcagaactggccgcagaacaccaaatctgggccgcagttgatccgaacgccaaaaaccaggcatttaactgtaccaacggggatctgttcaaatggaaacatatttggaaggttctggcaaaccaatttgatcttgagatggtagggtacattgaaggtaatgaacaggtgtcgatggaggaactcatgaaagacaaagatagtgtgtgggatgaaattgtcaagaaaaataatttaatgccgaccaaactgaaagagattgctgccttttggttcgcagacatagccttttgtctggaaaatgttctgtcatcaacacacaaaaaccgactacacggtttcatgggcttccgcaatacttacactagctttgttagctgcattgacaaaatgcgagcctaccgtttcattccg

SEQ ID NO: 1215 - DNA, 1176 bp, Thlaspi densiflorum
atgagctggtggggcgccggtgccattggtgcggccaaaaaaaaattcgatgatgatgaaccgacacagagctacgaaagcgtcgcgcttatcattggtgtcaccggaattgtggggaactctctggcggaaatattgcctctgtcggataccccaggaggcccttggaaagtgtatggcgtcgctcgccgcccccgtcccagttggaatgccgaccatccgattgattatattcaatgcgatgtgtctgatgctgaagatgcacgttcaaagctttcaccgctgaccgatgttacccacgtcttttacgtaacctggacctcgagatcgtccgaatccgaaaactgtgaagcgaacggcagcatgctgcgtaatgtgctgggggcgatagtacccaatgctccgaacctgcgtcatgtgtgccttcaaacgggcacaaaacactatctgggcccattcgatagtgcgggggatgagagcgtccatcgtcacgaaagcccatttacggaagacatgccgcgtcttcagatcccaaatttttattacaccctggaggacatcctgtttgaagaaattaagaaaaaagaaggcgtaacctggtctattcaccgccccaatactattttcggctttagcccgtatagcctgatgaacattgtgggtactttgtgtgtgtatgccgccatatgcaaacacgagggcagccctctgctgtttccgggttcaaaaaaggcgtgggaaggttttactacggcctccgacgccgacctcgtagccgaacaacagatttgggccgctgttgatgagtttgcgaaagatcaagcgtttaactgcaataacgcggatatattcaaatggaagcatctgtggaaggtgctggccgaacaatttggcattgaagagtacggttttgaagaaggtaagaacgtaggcctggtggaaatgatgaaaggcaaagaacgcgtttgggaagaaatggtcaaagaaaaccagctgcaggagaaaaaactggaagaagtgggggtttggtggtttgcggatgttattctcggcgtggaaggcatgatcgattcaatgaacaagagcaaagaacacggcttcctagggtttcgtaactccaacaatagctttgtgagctggattgataaatacaaagcttttaaaattgtaccctta

SEQ ID NO: 1216 - DNA, 1170 bp, Stellaria media
atgtcgtggtggggcgccggtgcaataggcgcagcgaaaaaaaaaatcgatgaagatgatgatgaaccgcagagttaccagagcgtgggcctgattgttggcgtgacggggattgtagggaatagcctggcggaaatcctgccgctggcggacacgccgggcggcccctggaaggtttatggcgtggcccgacgccctcgcccagaatggaataccgatcaccccattcagtacatacagtgcgacgtctcagatccggatgacgcgctgagcaaactctcccctctgaccgacgttacccatattttctatgtcacctggacgactaagtcaagcgaaattgaaaattgtcgcgcgaacgtcagcatgctgcggaatgtattgcaagcggtgattcctaacgcgccgaacatccaacacgtatgcctgcaaactggggctaaacactacgttggtccgtttgacagttttggcaagatccaaccacatgaacctccgttcacggaagacatgccgcgcctgccggtaccgaatttctattacgacctcgaagatgccttatttgaagaggttcagaaaaaagaaggcgttacatggagtgtgcatcgccccacgaccatctttggctttagcccgtattcattaatgaacattgtgggttccttgtgtgtatatgctgcgatttgcaaatatgaaggcaagccgttggtctttccggggacgaaagcagcctgggaaggctttgcggtggcgagcgacgcggatcttatcgccgagcagcgcatttgggcgagcgtggatccttttgcgaaaaacgaagcatttaattgtaacaacggtgatgtgtttaaatggaaacacctctggaaatctcttgcggaacaattcggcattgaggactatgggttcgaggaaggaaaaaacgtgggcctgaaaactatgatggacggcaaacaatccgtttgggaagagattgtgcgcaaaaatcaactgcaggaaaccaaactggatgaagtcgggtcatggtggtttgttgacattattttgggcgtggaaggcgccttagattctatgaataaaagcaaggaacatggcttcgcgggattccgtaaccctaaaaacagttttgtgagctggatcgataaatgtaaggcgtttaagatcgtgcct

SEQ ID NO: 1217 - DNA, 1167 bp, Erysimum crepidifolium
atgtcatggtggggcgctggtgcaattggtgcggccaagaaaaagctggatgatgatgaaccgagccagtcttacgagagtgtggccctgattatcggtgtgacaggcattgtgggtaatagcctggccgagatacttccgctaagcgacacaccgggcggcccgtggaaagtttatggcgttgcccgccgcccacgtccgtcatggaacgcagaccacccgatcgactatattcagtgtgatgtgagcaacgccgaagatgcgcgctcaaaactgagtcctcttacggatgttacccatgttttctacgttacgtggacgaaacgggaatcggaatccgaaaactgcgaggcgaatggctcaatgcttcgaaacgtgctgcaggcgattgttcctcatgctcccaatctgcgtcatatttgtctgcagaccggtaccaagcactatttgggcccgttcagcaatctggatggtccgcgtcatgacccaccgttcaccgaagatatgccgcgtctgcagattcaaaatttctattatacccaagaagacattctttttgaggaaattaaaaagaaagaaatttcagtcacgtggagcattcatcggcccaacaccatttttggctttagtccgtactcccttatgaatattgtgggtacactatgcgtctatgccgcaatttgtaaacatgaaggatcaccgctgctgtttcctggtagtaaaaaggcctgggaaggttttaccacggcatctgatgcagatctcatcgctgagcagcagatttgggccgcagttgatccctatgccaaaaatgaggcctttaactgtaacaatgcggatattttcaagtggaaacatctgtggaaaattctggcagagcaatttgggattgaagaatatgggtttgaggaaggcaaaaacttgggattggtggaaatgatgaaaggcaaagagcgcgtatgggaagaaatggtaaaagaaaaccagcttcaggaaaaaaaactggaagaagttggcgtttggtggtttgcagacgtgatactgggcgtggaaggaatgattgacagcatgaacaaatcaaaagagcacgggttcctcggcttccgcaactctaataattcgttcatttcttggattgataaatataaagcattcaaaattgtacca

SEQ ID NO: 1218 - DNA, 1134 bp, Morus notabilis
atgtcatggtggctggccggcgcaattcgtgcggcgaagaaaaaacgcgaatatgactacgcgccgagtgagtaccagtctgtggcactggtagtaggtgtaactggtatcgtgggcaatagccttgcggagatccttcccctgtcggataccccaggaggtccctggaaaaatgcagaccatcctattacctacattcagtgtgatgtttcggatccgcaacagactaaagatcacttatcaaaactcactgatgtgacacacattttttacgttacctggagctctcagcccaccgaggccgagaactgctccgtgaacggcgcgatgctgggcaacgttctcgaagcggttatcccgcatgcacctaacctgcagcacatttgtttgcaaaccggtcgtaaacattatattgggccttttgagcttctggggaaggttgagcctcacgaaccgcccttccatgaggatttgccccgcctcgatgcgccgaacttttactacgtacaggaggatatcttggtagaagaggtaaaaaaaaaagagggcctgacctggtcggttcaccgcccgggcgttattttcgggttcagcccgtcaagtctcatgaatatcattggcagtctgtgcgtgtacgcggccatttgcaagcatgaagggatgaaacttcgtatccccgggacccgtgaaggccgcgaggcatacctggatgcatccgatgcagacttgattgcggagcaccagatctgggcggcggtagatacatatgccaaaaacgaagcctttaattgtagcaacggcgatgtattcaagtggaaacatatgtggaaggtcttgaccgagcagtttgaactggagtacgaagaatttgaagatgacggcgattcgctgaccctggttgaaatgatgaaagacaaaggggaagtttgggatcagattgtcaaagagaatgggcttgtgcccactaatctggaggaggtaggcaatttttggtttgccgacctggtgctaacactcggcacgaccctagacagcatgaacaaaagcaaagagtatggttttgttgggtttcgcaattcgaaaagcagctttatctcgtggattgataaaatgaaaagctataagatcgttccg

SEQ ID NO: 1219 - DNA, 1176 bp, Helianthus annuus
atgtcgtggtggctgagcggtgtagttggcgccaccaggcgcaaacgtggcgataccaatccaagcttaaaatataaaggcttcgcgctgatcgtgggtgtgacgggaatcgtgggcaactcactggccgaaattctcccactgcacgacacgcctggcggtccgtggaaagtttatggtgtggcgcgtcgaccgcggccgccttggaacgcggattaccctatggagtatatccagtgtgatattcgtgatgaagagcagactctgacccaactgtcaaatctccaggatctgacgcacgtgttctatgtgacatgggcaaattgttctaatgaacagcataactgtgaaattaatggtcagatgttcaaaaacgttctgaacgccgtgatccctaattgcccgaatttacaacatatttgtctccagacggggcgaaatcattatattggcccattcgatgattggggcaccttgaatggcgtgcaggacgcgccattctgcgaagatttacctcgcatcgagaatccgaacttctattatacgctcgaagatatactgtttaaagaggtgacgaagaaagaaggcctgacctggagtgtacatcgccctggtgtaatttttggcttctccccgtgctcgatgatgaatattgtagggtccctatgcgtttatgccgcaatctgccgacatgaaggtgaacccctccgcttcccagggacacgccaggcatgggaaagctaccattcagcatcagacgccgatctgattgcggaacatcacatttgggcggccgtagatgaatatgcaaaaaacgaagtctttaatatatccaacggggatgtttttaaatggaaacatttctggaaagtgctggcggaacagttcggcgtagaaaatggtggtctgcaagaagaaggcgaacgccgtagtttatcagacatgatgaaagataaaggcgctgtttgggacgccattgtgactgagaaagaattactgccgaccaaacttgaagaggtgggcggctggtggtttgtcgatgtagtgctgggaaacgaggggatgttggatcttatgaataaatcaaaagaacatggcttcctgggtttccgcaactccaaaagctcgttcgttagctggattgacaaaattaaatgctcaaaaattgtaccaatc

SEQ ID NO: 1220 - DNA, 969 bp, Capsicum annuum
atgagctggtggcgagcgggcgcgaatggcgcggcaaaaaaaaaatttaaagaagatgacgcccctgcgaaatatgaaagcgttgcgctgattataggagttactagcattgtaggcaattccctggcgaaaattttgccgctggcggataccccgtcgggcccgtggaaggtgtatggcgtggcacatcgcagccgctcaagctggaacgccgatcactccatagagtatgtgcagtgtgatatttccaacccagaaggccatgacagtccgttccatgaagatctgccgcgcctggtggaaccgaacttttattacgttctcgaggacattttatttaaagcggtagagaaaaaagagggtctcacctggtcggtgcatcgtccaggaacgatattcggatttagcccgtattgtcttatgaacattgtcggcaccctgtgtgtatatgcggtgatctgcaagcatgaagggctaccgctgaaattcccgggtgtgaaagaggcctgggatgtgtattcggattgcagcgacgcggatcttatcgcggcccatcagatttggccggctgttgatccatacgcgaaaaacgaagccttcagtgtcagtaacggagatttttttaaatggaagcacttctggaaggttctcgcagaacaattcggcgtagagccagcagaatgttacgaggggaaacgttgcacgctgactaaaatgatgaaagataaaggtacggtttgggatgaaatcatgaaagaaaatggtctggtgccgatcaaactcgaggaagtaggtgtctggtggtttgtggacctgatgttagcgggtgattgcccgctggacaccatgaataaatccaaagagcacgcgatttttgcggtgcacatggcgcttaaatcgattattgataaaattacgatcgatacgccggattggacatgtaaagttcagatcgttgaaagccttacc

SEQ ID NO: 1221 - DNA, 1221 bp, Macleaya cordata
atgtcgtggtggtgggcaggagcgattggggcggccaaagcaaaattccttataccgaacctgagcctgagcctgctgcttttttgcttctttaagaaatttgaagaagatgaggtcccgccgaagtaccagtcggtcggtctgattatcggcgtgacaggcatcgtcggtaatagcctggcggagatcttgcctctgagcgacacgccgggcggaccgtggaaagtctatggcgttgcacgtcgcccgcgccccccatggaatgcagaccatccgatcgagtacatccagtgcgatgtctcggactccgatgaaaccctgtcgaaactgtctccgctcaccgatgtgactcatatattttatgttacttggacgagcaggaaaaccgaaagcgagaactgtgaagcaaatggcgctatgtttcgtaacgttctgcgagcgctgattccgaatgcaccgaatctgcagcatatttgtctccaaaccggtcgcaaacattatctggggccattcgaaaaattgggcgaagaaattgagcatcaggttctgccgcttcatgaagatttaccgcggttgaagactccgaatttttattacaccctggaagacattctgtttgaagaagtcgagaagaaagatggactgacctggtccgtgcatcgaccgggcacaatctttggatttagcccgtattcggtgatgaatctaattggcaccctgtgcgtttacgcggctatctgtaaacacgaaggcacaccgttgcgcttcccgggtacgcgcgtggcctgggaaggctattccgacgcgtcggatgcagatttaattgcagagcatcagatctggacctcggttgacccgtacgccaaaaacgaggcgtttaactgtagtaacggcgatgtattcaaatggaaacacttgtggaaagtcttaggtgaacagtttgaggtcgaatgcgcggaatttgaagaaggcttaaaattgggcgaaatgatgaaagacaaaggcccggtatgggacgagatcgtgaaacagaatgatctgtgcccgaccaagttggaagaggtgggtgcctggtggtttgtcgataccatgtttggggcgaaggaaagcatcctcgattccatgaataaaagcaaggaacatggctttctcggctttcgcaactccaattcagcatttgtgagctggatcgataagatgaaagcattcaagatcgtgccg

SEQ ID NO: 1222 - DNA, 1164 bp, Citrus clementina
atgagttggtggtgggccggagctattggtgccgcgaaagccaaatcatattccaagttcatcaataaactggaagaatatgaacaaacccgcgactaccagtctgtgggactggttgtcggggttaccggtattgtcggcaacagtcttgcagaaatcttgccccgtcccgataccccgggcgggccctggaaagtctatggtgttgcacgccgtccgcgcccaaattggaacgcggcgtatcccgttgaatatcttcagtgcgacgtgtcagatcaggaagatacccaggcaaaattgtctaagcttacggatgtgacgcacattttctatgtgacttgggacggccggcgtaccgaggctgaaaattgccaaattaacggtgcgatgcttcataatgtgctgcggtcagtgatcccgaacgctccgaacctgcgccatatttgcttgcaaacgggaggcaaatactacatgggtccgctggaattcattggtaaaattccgtcgcacgatcctccgtttacagaagacctgccttcgctgaatattagcctgttctactacaccctggaagatattctcttcgaagaagttgataaacgggaaggcagcacctggtcggttcaccgcacattcggaatattcggcttcctctcgtttggcgtgctgatgaatattattgcaaccctttgtgtatacgcggccatttgcaaccatgagggcgttccgcttttgttttacggtacgattgatacctgggaagggttccagcaagtctctgatgccgaattgattgcggaacagcagatttgggccgccctggatagtaatgcacgcaatgaggactttaattgcactaatggcgattttgaaatcgaggattatggattagaagacggaaagggctgtgaacgtgtacgcttggaagaaattatgaagggcaaagagagtgtctgggaggagatcgtgcgcgagaaccagctgcagcctacgaaactgaacgaagtggccgtgtggtcgttcgccgatacggtgatgaacatgggggccggttacctggtgtcagtgaacaaaagcaaggaacacggttttctcggtcaccgaaatagcaaaaattcttttgtgacgtggagcggtcgtctgaaaagccaccgtattgtgccg

SEQ ID NO: 1223 - DNA, 1176 bp, Arachis ipaensis
atgtcgtggtggtgggctggtgccatcggtgctgccaaagccaccaagaaattcgaagacgatgagccgcctcggagctttcagtcagtagggttgatcataggagtaacgggaatcgtggggaactcactggccgagattcttccgctggccgacacacctggaggcccgtggaaggtttacggggtagcgcgacgtccccgacctagctggaatgtggaccacccgatcgaatatattcagtgcgatatctcggaccccaatgatacccagtctaaattaagcgcgcttactgacgtcacgcatattttctatgtttcgtggactcgccgccctactgaagcggaaaactgtcaagtgaatggcgcgatgctgcgcaatgttctgcaagccgtgatcccgaatgccccgaacctccgtcatgtgtccctgcagacgggtggtaagcattatttaggaccttttgaactgttcggcaaaattcagccgcacgagccgccgttcaccgaagatttaccacgcctgaaagcaccgaatttttattatacccaagaagatattctatacgaagaaacgcaaacaaaagacggcgtgtcgtggtctgttcatcgcccgcaggtcattttcggcttctccccttattccctgatgaacatggtaggaaccctgtgcgtttatgcggcaatctgtaaacacgaacgcgtccctctgcgctttccgggcaccaagtcggcgtgggaagattacaccactgcaagcgacgcagacctgattgccgagcagcacatctgggcagctgtggatgcgtatgcgcgtaacgaggcatttaactgcagcaatggggatgtgttcaaatggaaacacctctggaaagtgctggccgaacaatatggtattactgaatatggtttcgatgaaggtagcgaacgtttgaaattgagcgagatgatgcgcgataaaggtcctgtatgggatgaaatcgtgcgtgaaaaccagctgagcccgacgaaactggaggaggtggcggattggtggtttgttgatgtaatgttcggcggcgccggcttactcgatagcatgaacaagtcgaaagagcatggctttctgggttttcggaattccaaaaactcctttataagctggatcgataaaactcgagcatttaaaattgttccg

SEQ ID NO: 1224 - DNA, 1173 bp, Vitis vinifera
atgagttggtggtgggccggggcaattggtgctgccaaaaaaaaatttgatgaggatgatgcgccccgggggttccagaatgtaggactggttattggcgtaacgggaatcgtgggcgatagcctagccgaaatcctcccgttatcggataccccaggcggcccctggaaggtatatggcgtcgcgagacggccccgaccggactggaatgcggatcaccccgtggaatacacccagtgtgatataagtgattcagaggatgctctcgcgaagctgagtccgctgacggatgtaacacatgtgttctacgtcacttggacaaaccgcgccacggagattgaaaactgcgaagcgaacggcacgatgctacgcaatgttcttcgcgcgttaatcccaaacgcaccgaacttacgtcacatctgcctccagacagggggtaaacattatatcggtccttttgaagcatttggaaagatcaaaccgcatgacccgccttatcacgaagacttaccgcgcctggacgccccgaatttttactatactctggaagatattctgtttgaagagtgcgagaaaaaagacgatctcacctggtcggttcatcgcccagtgattatttttggtttctctccatattctatgatgaacatcctgggtaccctgtgcatatacgcggccatttgcaaacacgaaggtattccactgaaattccctggcagcaaagccgcgtgggactgttactcggacgcgagcgatgcggacctcatcgctgagcagcaaatctgggcaacggttgatccgtacgcgcgtaacgaggccttcaatattactaatggcgatttatttaaatggaaacacctgtggaaagttctggccgagcaatttgacatggagtacgccgaattcgaagaaggcgaagagaaacagtcgatggtagagatgatgaaagataaaggcccggtttgggaagaaattgtacgggagaaagagttacttccaaccaaactggaagatgtggcgcagtggtggttcattgacttagtactgggcggcgaaagtctcttaaactgcatgaacaaaagcaaagaacatggatttttaggtttccgcaattcgcgtaattcattcgtttggtggatcgacaaaatgcgcgggcacaaactgatcccgcct

SEQ ID NO: 1225 - DNA, 1170 bp, Hevea brasiliensis
atgagttggtggtgggcgggggctattggcgccgccaaaaagaaatttgatgaagatgacgcgccgcgctcatttcagtcagtcggtctcgtcctgggtgtaacaggtattgtgggcaattcactagccgaaattctgccattatctgatacgccgggtggcccctggaaggtatacggtgtggcgcgtaggccacgccccaactggaacgcggaccatccagttgaatatgtacagtgtgatatctctgatcaagccgagacgcaggccaaactgtcccaactgaccgacgtgacccatattttttatgtaagctgggctaataggagttcggaagccgaaaactgtgaaattaatggcagtatgttacgaaacgtgctccaggcagtgatcccgaacgctccaaatctcggccacatttgtctgcagaccggcaccaaacattacgtgggcccttttgaactgttcggtaaaattcagccacatgatccgcctttcaccgaagatctgcctcgtctgaacgtgccaaacttttattatactctggaagatattctgtttgaggaggccgcaaaaaaagaaggtcttacttggagcatttcgcggccggatcagattttcggcttttccccgtactccctaatgaacattataggcactttgtgcgtctatgcggtgatctgcaaacacgaaggcctgccgttactttttccgggaacaaaacaggcctggaattgttactcaattgcctcagatgccgacctgattgcagagcaacacatctgggcctcagtcgatccgtacgcccgcaatgaagccttcaactgcaacaatggagacgtgtttaaatggaagcatttctggaagatcttagccgaagaattcggcatcgaaaaatatggttttgaagaaggtgaaaagaggctgagtctggttgagattatgaaagataagggtccggtgtgggaagaaatcgttcgcgaataccagctgcaccccaccaagctcgaagaagtaggtgtctggtggtttgccgatctgattcttgggggcgaagctgtgattagtagcatgaataaatcgaaggaacacggctttttggggttccgcaattctaaaaattcctttatctactggattgacaaaatgaaggcctataaaattgtgccg

SEQ ID NO: 1226 - DNA, 1167 bp, Dorcoceras hygrometricum
atgtcctggtggtgggccggcgcgattggggcggccaaaaagaaatttgacgaggacgagaatcctgcaaagcatcaaagcgttgccttaattattggtgtaacgggcatcgtcggcaactcattggccgagattctgcctctgagtgacacgcctggtggtccgtggaaagtgtacggggtggcccgccgtccgcgcccggcatggaatgatgacaatccgacgaactacatacgctgtgacgtttcagacgcagatgatgtgcaggagaagctgggttcactgacggacatcacccatgtgttctatgtcacgtgggcgtcgttatccacggaggccgaaaactgcgaagttaacggccgtatgttgtccaacgttttagatgtggtcatcccgaattgtcctggtttgaagcacatttctctccaaaccggccggaaacactattttggccctgtggaatcatttggcaaaattgccatccacgatcctccttttgatgaaagcctgccgcgtcttgatcatataaacttctactacacgttggaggatatcttattcgccgtcgtgggcaaaaaggaaggtctgacgtggtccgtgcatcgcccgggcactatttttggcttttcaccctacagtctgatgaatttagtcggcaccctctgtgtatatgcggcgatttgcaaacatgaaggtatgcctctgcgttttcccggctcgaaaagcgcatgggacgggtatagcgattgctcagacgcggacttaatcgcagaacatcacatttgggcggccgtcgatccatacgcgaagaatgaagcgttcaacgtgagcaacggcgatgtgttcaagtggaaaagcttttggaaagtactggcagagcagttcgatgtcgaatacgccgaatttcaggagggacaaaaactgaaacttcaggaggttatgaaggacaaaggttccgtctgggatcagattgtgcgcgacaatggcctgaccccgacaaaactggaagatgtaggtaattggtggtttagcgatttagtgctttcctctgaagggttactcgatacgatgaataaaagcaaagaacacggcttcctcggattccgtaactctaagaactcattcgtgtcatggattgataaagtgaaagcgtataagatcgtccct

SEQ ID NO: 1227 - DNA, 1170 bp, Brassica napus
atgagctggtggtgggcgggcgcgataggcgcggccaaaaagaagtttgatgaagatgagccgacccaaacgtatgagtccgtggcgctgattattggcgtaaccggtattgtcgggaatagcctggccgaaatcttgcctctgagcgataccccgggcggcccatggaaagtatatggtgttgcccgtcgcccgcggccgacgtggaacgccgatcatccgattgattacattcagtgcgatgtctccgacgaggaagacgcacgtagcaagctttctcctctgcgcgatgtgacacatgtcttctatgtgacctggaccaatcgctcggtggaaagcgaaaattgcaaagttaatggatctatgttgcgtaatgttctgcgtgcggtagtccctaatgcaccgaaccttcgtcatgtgtgcctgcaaacaggtaccaaacactatctgggcccgttcgacagcgtggggaaagcggtggatcgtcacgaagcgccgtttactgaggatatgccgcgcctgaaagtagataacttttactatacattggaagatgtgctgtcagaagagattaaaatgaaggaaagcgtcacatggtcagtccaccggccgaacaccattttcgggttctcgccatatagtctcatgaatattgttgggaccttgtgcgtctatgcggccatttgcaaacacgagggtagtaaactggtgttcccgggcagtaaagaagcgtgggaaggatttacgacggcgtctgatgcagatttagttgcggaacagcaaatttgggcagcggttgatccgtacgcgaaaaacgaggcctttaactgctcaaacgcggatgtattcaaatggaaacatttgtggaagatactggctgaacaattcggcattgaagaatatggctttgaagagggcaagaacgtgggcctagttgagatgatgaagggcaaagaacgtgtatgggaagaaatggtgaaagagaaccagctccaagttaaaaaattagacgaagtgggagtatggtggtttgcggatgtcgtcctgggcgtcgatggaatgatagatagtatgaataaaagcaaagagtatggttttttgggttttcggaactctaataacagtttcatcagctggatcgataaatacaaagcattcaaaattgtcccg

SEQ ID NO: 1228 - DNA, 1167 bp, Ziziphus jujuba
atgagctggtggtgggcgggggccatcggcgcggcgaaaaagaaatttgattcggacaatgcgccggcaaaacaccattccgtggcgttagtagttggagtaaccggcattgttggcaattcgctggcggagattttgccgttaagcgacaccccaggcggtccgtggaaagtgtacggcgtggcccgccgcccgcgacccccctggaacgccgatcatcccattcattatattcaatgtgatgtgagtgacagccagcagaccaatgagaagctttctgatttaacggatgtcactcatattttttacgtggcgtggacgtcacgtccgaccgaagcggaaaatagtgatattaatgggcgaatgttgctgaatgttctgaacaccgttattccgattgccccgaatctgttgcatatctgtctgcagacgggtcgtaaacactatatgggcccgtttgagctgctgggtaagatcaaaccgcacgaacccccgttccatgaagacctgcctcgtctgaaagttcctaatttctactatacccaggaagacattttactggccgaggttaacaagaaacaaggtctgacttggtcagttcatcgccccggcgtgatttttggattctcaccttatagccttatgaacattgtcgtttcgctatgtgcctatgcctccatttgtaaacaccagggtcaggcactgaagttccctggaagtcaggcggcgtgggatggcttctgcgacgcctccgatgccgatctgatcgcagaacatgaaatatgggccgccgtggaccccttcgctaaaaatcaggcgtttaattgttcgaatggggatgtatttaaatggaaacatctatgggaagtattagccgagaaatttgggcttgagtactcagcggaattcgacgttaaactgacactggaggagatgatgaaaggtaaagattgggtttgggatgaaattgttaaagaaaagaacctcgtgcctaccaagctggaggagattggaggctggtggttcgcggatattatcctgggcctcaacgaactgcacctggattctatgaacaagaacaaagagtacgggttcgtggggttccgcaactcaaaaacctcctttggcagctggattgataaaattaagtcatatcgcattgtcttg

SEQ ID NO: 1229 - DNA, 1182 bp, Punica granatum
atgtcttggtggtgggcaggggccattggtgcagcaaaaaagaaatttgaggaagacgatgcgccgaaatcgttccaaagcgtcggcctagtagttggcgtgactgggattgttggtaactccctggccgaaattcttccgctcgcagacacacctggtggtccgtggaaagtatatggtgtggcgcgtcgcccgcgcccatcctggaacgcggatcatcccgttgagtacatccaatgtgatatctcagaccctcaggacgcagaatccaaattaagcgtgctgacagatgttacgcacatcttctatgtgacttggacaaacttgatcgcggaggtggaaaactgcgaggtaaatggtcgcatgttgcgcaacgtgctccgggcggtcctgccgaatgcgccgaatttatgtcatgtctgtttacaaacaggtcagaaacactatattggtaattttgaagacatggccaccggtaaagtgcgcccgcacgaaccaccctacaccgaagacctgccacgtcttgattgcccgaacttttattacaccctggaggatatcttatacgaggaagtagccaagaaagacggtgtatcgtggagcgtccatcgtccgccggtgatttttggcttcagcccgtattcactgatgaatatggtaggatccctgtgtgtttatgctgcaatctgcaaacacgagggaacgcccctgaagttccctggtaccaaggaaacatgggagtgttattgcatcgcgggagacgctgacctgattgccgaacagcagatttgggcagccgtagatccttatgcccgtaacgaggcctttaactgtagcaacggcgatgtgttccgttggaaacatttctggaaggtcctggccgaacaatttggtattgaagaatatggattttataaaaaagaaggtaaattgggactggaagaagcgatgaaagggaaagaaaaagtgtgggaggaaatagtccgcgaaaaccaactgcagccaactaagctggaagaggtgggcatctggtggtttgtcgatttagtcttatccggtgatgcggggctggactcaatgaataaaagtaaggagcacgggttcctgggttttcgcaactctcgtaattcttttatttattggattgataaggtcaaaggctataaaatcgtcccgggtgcg

SEQ ID NO: 1230 - DNA, 1173 bp, Capsicum baccatum
atgtcctggtggtgggccggcgcgattggcgccgcaaaaaaaaaatttgaagaagatgatgccccgccgaaatacgatagcgtggctctgattattggggtcactggcattgtcggcaacagcctggcggaaattctcccgctggctgacacgcccggtggaccgtggaaagtatatggcgttgcgcggcgtttccggccgtcgtggaacgcggatcatccgattgagtatgtgcagtgtgacattagtaaccctgaagatacccagtcaaagctgagcgtgctgacagatgtaactcacgtcttttatgtgacttgggcgaatcgctcaacagaagtagaaaattgcgaaattaatggtaaaatgttctccaacgtgctgaatgttattattccgaattgtccgaatctgcgtcatatttgcttgcagactggccgtaagcactatttagggccgtttgagctgttcggcaaggttggcaaggttggtcacgatagcccttttcatgaagatctaccgcgcctggatgccccgaatttctattatgtcctggaggatattttgtttaaagcggtggcaaaaaaggaggggttaacctggagcgtgcatcgcccgggtacaatctttggattttctccgtacagtctgatgaacatcgtgggtacactgtgcgtgtacgcagcgatatgcaaacacgaaggtttacctttaaagttcccgggcgtgaaagccgcctgggacggttatagcgattgttcggatgcggatctgatcgccgagcatcagatttgggcggcagttgatccatacgcgaagaacgaagccttcaacgtttccaacggtgatgtgtttaaatggaagcatttttggaaagtgctggcagagcagtttggggtggaaccggcagaatttgacgaaggtaaacgctgtacgctgacagagatgatgaaggataaaggcactgtctgggacgagattgtgaaggaaaatggtctggtgcccactaaactggaagaggtcggcgtgtggtggttcgttgatctgatgctggcgggcgattgtcccctggatacgatgaacaaaagtaaagaacacggcttcctgggcttcaggaatagtcaaaaagcctttattagctggatcgaccgagtgaaagcttacaaagtggttcct

SEQ ID NO: 1231 - DNA, 1167 bp, Carica papaya
atgagttggtggtgggcgggtgccatcggggcggctaaaaaaaaatttgaagaagacgacgccccgcgcagttttcagagcgtagccttggtcgtcggagtgaccggcattgtgggtaatagtctggccgaaattttgcctctatcggataccccgggcggcccttggaaagtttatggcgttgcgcgccgtccgcgtccgacctggaacgccgatcatccgattgagtacatccaatgtgacgtaagcgatatggaggaaacccgggcgaagttaagtccgattaccgacatcacccatatcttctacgttgcctggagcaatcgttctaccgaacgcgagaactgcgaggtgaacggcgcgatgctgcgtaatgtgctccaggtggtgattcccaactcacccaacctgtctcacatctgtttgcagacgggtgccaaacactatgtcggcccgtttgaaaccctcggtaaaattcagtttcacgatcctccttttactgaggatatgccgcgcttggatacccccaatttctattacacccaggaagatatactgttcgaagaagttgagaagaaagagaatttgacctggtctatccatcgccccttggtgatctttgggtttagtccgtactgtatgatgaatatggtgggtattttatgtgtgtatgcggcgatttgtaaacatgagggtagcccgcttattttcccgggcagcaaagcgagttgggacagttacagtaccgtgagcgatgctgacctaattgcggagcaacagatttgggcggcggtggatccatatgcgaagaacgaagcgtttaactgcagtaatggtgatgtcttcaaatggaaacacttttggaaggtgctggcggagcagttcggcatcgaagaatacgggttcaacgaaggcaaaagctttaagttagaagaagcgatgaaggataagggctcagtatgggatgaaatcgtgcgtgaaaatcaactgtatccttcgaagtacgaagaagtagcagtctggtggttcgtcgacgtaatctttggtatggagggtgttttgggttgcatgaacaaatcgaaagaacatgggtttctgggttttcgcaacagcaaaaactcgtttatttcttggatcgataaaatgaaaggttacaaaatagttcct

SEQ ID NO: 1232 - DNA, 1173 bp, Gossypium hirsutum
atgtcttggtggtgggcgggggcgattggcgccgccaaaaagaaattcgaagaggatgaggcgccgcgctcgtttcagagtgtcgggttaattattggtgtgacgggtatcgtgggtaactcgcttgccgaaattctgccgctgagtgacacgccaggcggcccgtggaaagtatacggggtggctcgccgccctcgccctaactggaatgcggaccatccgattgagtacatacagtgtgacattagtgatcctaatgatactgagtcaaagctgtcacagcttaccgacgtcactcatatcttctacgttagttggataaatcgtacctcggaagctgaaaactgtgaaattaatggctcaatgctgcgcaacgtcctgcatagcgtgattccaaacgccccaaatctgcgccatatttgcctgcaaactggtgcaaaacactaccttgggccgtttgagctgctgggcaaaattcaaccccacgatccgcctttcactgaggatctgccgcgtctgaacgccccgaacttttattatcaccaagaagatattctgtttgaagaaattgaaaaaaaagagggcttgacatggtctgtgcatcgacctggagtgatttttggtttcagcccatacagcctgatgaatcttgtgggctcgctctgtgtgtacgccgccatctgcaaacacgagggaaaacctctgcattttcctggctccaaggctgcgtggaactgctacttcgaagcgtcggacgcggatctgattgcagaacaacatatttgggcggcggttgatccctatgcaaagaacgaagcgtttaatgtaacgaatggcgatgtgttcaaatggaaacatctgtggtcggtgctggcagaacagtttggtattgaagaattcggctttgttgaaggcgaaaaccgtggcatggaggaaatgatgaaagaaaaagaaggtgtgtgggaggaaattgtgaaagaaaaccaactgcagaagacttcgttgcaggtggttggcaattggtggtttacggatacaattttcttggcgccgctgcagatgcctcttctcagtatgaacaaaagtaaagaacatggcttcctgggcttccgcaattctcgaaatagctttgtgacctggattgataaaatgaaggcatacaaaattgtgcct

SEQ ID NO: 1233 - DNA, 1182 bp, Cucumis sativus
atgagctggtggtgggccggcgccatcggtgccgccaaaaaaaagtttgaagaagatgagccgcctcgttcttttgaaagtgttgccctggtcattggcgtaacaggtatcgtcggcaatagtctcgcagaaattctcccactgagcgacaccccggggggcccgtggaaggtttatggtgtggcccgtcgtccgcgtcccgcgtggaacgctgatcatccgattgaatatatccagtgcgatgtgtcggatccgcaggatgcagaaaccaagctgagccaactggcggatgttacccacctgttttacgtgacttggaccaatcgcacgactgaaatcgaaaactgtgaagccaacgtcaaaatgttacgcaacgtgttacgttctgtaatcccgaacgcaccgaacctgcgtcatatttgcttacagaccggcaccaagcactacgtgggttcatttgaaagtattattaacaaatcttcccaacgacatgacccaccgtttaccgaggaccttccgcgcctggaatgtccgaatttctactataaacaagaagacctactttgggaggaaattgagcagagtcagaagaaagacttgacctgggcagtaattcgcccgaatttgatctttggattttccccgtttagcctaatgaatgtcgttggaaccctgtgtgtgtatgcggcgatttgcaaacatgagggtcgcccgctcaaattcccgggcaacaaactcgcttgggaggacttccaagttgcaagtgatgcggatctgatcgcagaacaacatatttggaccgcggtggacccgtattccaagaatgaggcctttaattgtaataatggcgatgtattcaaatggaaacatttttggaaggtccttgcagaacagtttaatattgaggaatatggcttcgatgaggagggagagagcctgaccttagtcgatctgatgaaggataagagcgatgtctgggatgagatcgtgaaagaaaaccagctgcagcagactaaactcgaggaaattggaacctggtggttcgttgacagtattttctcgatgtccggaaatatagactccatgaacaagagcaaagaacatggatttctgggatttcgtaacagcaaaaacagcttcatctcgtggatcgacaaaatcaaagcgttcaaaattgtgccc

SEQ ID NO: 1234 - DNA, 1197 bp, Citrus clementina
atgagttggtggtgggcaggcgccatcggtgcggcgaagaaaaaatttgaggaaaacgaacgccagccgcagccgcagccgcaggattaccagcatgtcggcttagtgatcggcgttacaggcatagtcggcaatagcttagcggaaattcttccgcgccaggatacccccggtggtccgtggaaggtttatggtgttgcccgtcgcccgcggcctgattggaacgcagatcacccgatcgagtacattcaatgcgatgtgtctgatcaggacgatacacaggctaaattatcgaaactaacggatgtgacccatattttctacgttacctgggcgtccagacccacggaagcggagaactgcgaggttaacggagccatgctgcgcaacgtcctccgtagcgtgattcccaacgccccaaacctgcgtcatgtgtgcttacagaccgggggcaaacactacgttggcccgttcgaatcatttggaaaaatccgcccgcatgatactccgtttacggaagacttaccgcgtttgaacgtgaccaatttttactacacccaggaagatatactgttcgaggaagttgaaaagcgtaaaggaccgctgagcttaacatggagcgttcatcgcccgcatatcatttttggcttcagcccttacagcatgatgaacgttgtcggtacgctgtgcgtgtatgcagcgatttgtaaacatgaaggagttccattgctgttcccgggctcaaaagattgctgggaaggttactcagtagcgtcagatgcagatctgattgcggaacagcagatctgggccgcggttgatccgtacgcgcgcaatgaagctttcaattgttccaatggcgacgttttcaaatggaagcacctgtggaaagttttagctgagcaattcgagattgagaactatggtctgccgcaagagggggaacgggttcgtctggaagaaatcatgcgtggcaaagagggagtgtgggagcagatagtgaaagaaaaccagctgcagttgaccaaactgtccgaggtggccgtttggtggtttgccgatatgatgttagatggcggattcctgctactggattctatgaataaatccaaagaacatggttttctgggttttcgtaatagcaaaaattcctttgtaaattggatcgacaaaatgaaaacctaccgcatcgtgccg

SEQ ID NO: 1235 - DNA, 1161 bp, Catharanthus roseus
atgagctggtggtgggcgggtgctattggtgcggcgaaaaagaaatttgaatttgatgacgcccctccaaaatatcagagtgtgggtttgattctgggtgttaccggcatcgtaggcaacagccttgcggagattctgccactctctgacacccccgggggcccgtggaaagtatatggagtggcgcgccgcccgcgtccatcatggaatgccgatcatccgattgaatacattcagtgcgatatttctgatcctgaagagacagaatctaaactcagcaaattgaccgatgtgacacacgtgttctatgttacatggaccaacaagtcgaccgaagtggaaaactgcgaagccaacggtaaaatgttccggaatgtgttgaatgcaataattcccaactgtccaaacctgcagcacatttgtcttcagacgggcttgaagcattattttggtccgtttgagttttttggaaaggcggcccaggaaaccccgtttcacgaagatctgcctcgcctggatgtaccgaacttctactatactttagaagacattttgtttgaggaggttcagaaaaaggagggactctcgtggtcggtacatcgcccaggtacgatctttggctttagcccgttcagcttaatgaatcttgtgggtaccttatgcgtatatgcggccatttgtaaacacgagggcctccctctgaaattcccgggttgcaaggaggcctgggagggctactcaatgtgtagtgacgctgatctgatagcagaacaacagatttgggcggcggttgatccgtatgcaaagaacgaagcgttcaacgtgagtaacggtgatgtgttcaagtggaagcacttctggaaggttctggccgaacagttcggcctcgagtgcgcggagtatgaaggcgacaaagtcagtctggaagagatgatgaaggacaaagaagcggtttgggaggagatcgtccgagaaaacggccttttgcccactaaactcgaagaagtcggagggttttggttcgtggattttatcttcggggtagagtatccgctggatagcatgaacaaaagcaaggagcatggttttctgggcttcagaaacagtaaaaacgcctttatcagctggattgacaaagccaaagcgtacaaaatcgtacct

SEQ ID NO: 1236 - DNA, 1167 bp, Fragaria vesca
atgtcatggtggtgggccggtgccattggtgcggcgaaaaagaagttcggacctgatgatgagcccccgaaatatcagagcgtcgccctagtgctgggagttaccggcattgtaggcaacagcctggccgaaattttaccgcttcctgatacaccgggcggcccgtggaaagtctatggtgtggcgcgtcgcccgcagcctcagtggaacgcggaccatcatatccagtatatccaatgtgatctgtccgattccgagcagaccgaaactgaattaagccagctgacggatgtgacccatatcttttacgtgacttgggcgtccaaaccgtcagaggcagaaaactgcgaagcgaacggcaagatgctcagcaatgttctgaatgctgtgattccgaacgcgccgaacctgcaacatatttgtatgcaaaccggacgtaaacaatacgttggcccgttcgagatgttcgggaaaatcgaacctcacgaaccgccgtatgtggaagatactagtcgcctcgactgtcccaacttttattacgtgatggaagatattttgttcgaagaagtgaaaaaaaaagaaggcttgacctggagtgtgcatcgtccgggaattatttttggattctcgccgtactccttgatcaacaccatcggtagcctctgcgtctacgcggcgatttgtaaacacgaaggccaaccgctgcgttttccggggtctaaaggcacatgggagggcttctgggatgcttctgacgcagatatgattgccgaacatgaaatctgggccgctgtcgagccttatgcaaaaaacgaagcgtttaactgcagcaacggagatgtgttccggtggaaacacctgtggggaattttagcggatcagttcgaagttgagagcggcggtgtcgatgaggaacttcgcgttgaagaaatgatgaaagataagggcccggtgtgggacgaaattgtacgcaaacatgacctggttccgagtaaattagaggaggtaggcaattggtggctggttgacataattttccgcattggcgtggattcttccatggatagcatgaataagagccgtgaacatggttttgttggattccgcaactcaaaaacatcatttctgtcttggattgacaaaatgaagagttaccgtattgtaccg

SEQ ID NO: 1237 - DNA, 1215 bp, Prunus avium
atgagctggtggtgggctggcgccataggtgctgcaaaaaaaaaacatgaagatgatgatcacgaagcgccgcgttctttcaagagcgtcggtctggttataggcgtgactggattggttgggaattcgttggccgaaattctcccgctgcacgatacgccaggaggtccgtggaaggtctatggtgttgcccctcgcccccgtccagattggtcagtggaccaccctgtggagtacattcagtgtgatattagcgatccgattgatgcacagaccaaactgagccagctcacggacgtgaccgacattttttacgtgacctggacaagccgatcaaccgaagcggataactgtgaagctaacggtgcattgctgcgtaacgtcttgtcgtcagtaattccaaacgcgcccaatcttcggcatgtttgtctccagacgggcaccaaacactatgacggtccgtttgaagcctacggcaaagtcgcgccgcacgatacaccgtcgacggaggatctgcctcgcttgaacgtcccgctgttttactataacctggaagacgttctattcgaagaggttgaaaaaaaggaaggcctcacttggtcggtccaccgcccgggtttaattttcggtttcagcccgtatagtatgctgagtattgtctcaatgctctgcgcgtatgccgccatctgcaaacaagagggtctggcactccgcttcccaggatcaaaagccggctgggattcctattcggaagcaagtgacgccgatttgatcgcagagcaacagatatgggccgcagtagacccctatgctaaaaatgaagccttcaacattaacaatggagatgtgtttaaatggaagcagctgtggaaagtgcttgccgaggaatgggatgtttttaaatggaaacagctctggaaagtcctggccgaagagttcgaaattgaagaatacggcttcgatgagggattttcgctggtggaaatgatgcgcgataaaggaggcgtgtgggaggaaattgttggcgaaaaccagttgcggcatactaaactggaagaactgggactgtgggaggttgttgaggtggttcttggcggcggtgcggaactttcaagcatgaataagaacaaagaacacggcttttgcgggttccgcaactcgcggaacagcctggtatattggatcgacaaaatgaaggcccataaaattgtcccg

SEQ ID NO: 1238 - DNA, 1167 bp, Salvia rosmarinus
atgtcgtggtggtgggcgggcgctattggggccgcgaaaaaaaaaatcgacgaagatgaaccgccaccaaattaccaatctgtcgcgctggtggtgggtgtgaccggcattgttggcaacagcctggcggaaattcttccgctgagtgataccccgggcggcccgtggaaggtgtacggagtagcacgccgccctcgtccttcgtggaacgaagatcatccgatcaactatattagttgcgatgtgtcagacccggatgatgtaaaaagtaaactggcccctcttaccgatattacaaacattttctacgtaacatggactaaccggagcacagaagaagaaaattgtgaagccaacggcaagatgttgaagaatgtattgaacgtggtgattccgaactgcccaaatctcaaacatatttgtctgctgacggggcgcaaacattacctgggcccgtttaacagtgtatggaagattcaagtgcccgatccacctttcacggaagatttaccgcgtctggattgtccgaatttttattacactcaggaagatattttgttcgaggaagtgcaaaagaaagaaggtttgacgtggagcgttcatcgccccggggtgattttcggttttagcccttacagcatgatgaatctggtgggtactctatgtgtgtacgcagctatctgcaaacacgaaggtgccgtgttacgttttccgggctgcaaggatgcctgggatggttactccgattgctccgatgccgatctgatcgccgaacatcaaatttgggccgcagtcgatccgtatgcaaagaatgaagcctttaatgtatcaaacggcgacgtgttcaaatggaagcacttctggaaagtgcttgcggaacagtttggattggagtgtggcgagtatgaagaaggcaaagaggtgaagctgcaggaactcatgaaagaaaagggtccggtctgggacgaaattgtacgcgaaaacggcctgtcatgcacgaaactggaagatgtgggcaaatggtggttcagtgatctcattttagaacacgccggcatgctggatacgatgaataaaagtaaggagcatgggtttctgggcttccgcaatagcaaaaatagttttatctcttggatcgacaagttgaaagcctacaaaattgtgccg

SEQ ID NO: 1239 - DNA, 1275 bp, Elaeis guineensis
atgagctggtggtgggccggtgcaattggtgcggcaaaaaaaaaaatcgacgaggattcgggtggaggtggcggagggggtgcgccgaaatttcagtccgttggcctggtcattggcgtgacaggtattgttggcaacagcttggcagaaatcctgcctctgagcgacacacctggaggcccatggaaagtgtatggcgtatcacgtcggccgctgtctgtttcttttaggcctctgaccgaaggcttagccgttgagcatatccaatgtgatgtaagcgaccctgacgatgcgcttgcgaaacttagcccgctgacggatgtaacgcacgttttttatgttgcgtgggctaaccgtattgttgaagcagagaaccgcgaggttaattccgcgctgctacgaaacgttctggcggcagtgctgccgaacgcgccgaacttacagcatgtctgcctgcagaccggccgcaaacattacctcggcagttttgaatcgctgggtaaagtaaaagcgcatgaaccgccgttccgcgaagacctgccacgcctagattgccctaacttctattatgatctggaagatatactgtttgaagagatggcgaaacgtgatggcactgttacgtggagcatccaccgtccaacgaccattttcggtttctccacctactcattaatgaacctggtgggcagtctgtgtgcgtacgcagcgatctgccgtcgcgaaggcgcgccgctgaaatggcccggtagccgcgtggtgtgggaggatttttcggatgcgtctgacgctgacatgatcgcggaacatcagatctgggcagcaattgacccgtatgccaagaatgaagcattcaattgttccaacggcgatctgttcaagtggaaacatctctggccgctcttagcccgagaattcggggtcgaatgggtgggttatgaaggcgaagaacagcgttttaaactggttgatgcaatgaaagagaaagagggcctgtgggaagaaattgtcgcggaacacgagctcgcacccacacgtctcgaagaggtgggaaattggtggtttgtggacgcggtgtttggcgtcgaagaagttcacctggattcgatgaacaaaagcaaagaacatggcttcctgggcttccgcaatactgtggtatccacaattatgtctcactgcattcttcatctggaaccgtgggatccgaacattctcactctgcaagtggaccatcgcagtgagtgcatttatgagcgtgagggtttaacattttat

SEQ ID NO: 1240 - DNA, 1173 bp, Erythranthe guttata
atgtcgtggtggtgggcaggcgcgatcggagcagcgaaaaaaaaaattgaagaagacgaaccccctcagaaacacgagggggtggccttgatagttggcgtgaccggtattgtgggaaacagtcttgccgaaattctaccgcacagtgataccccgggcggaccttggaaaatctatggagttgcccgacgcccgcgtccgacgtggaacgcagataatccggtaaactatattcagtgtgacatatctgatccggaagatacccgggttaaattatcgccgctgaccgacatcactcacgtgttctatgtgacctgggcaaacaagtccactgaagccgaaaattgcgaagttaatggtaaaatgttacagaatctgttagacgcagttatccccaacagccctaatctaaaacatatttgcctacaaactggccgtaagcactatattggcccgtttgaatcgtttggcaaaaatattccgacgcatgatccgccatataccgaggatctgccgaggctgaaccatatcaacttttattacacgctggaggatattttattcgcggaagttgaaaagaaagaaggcctgacttggagtatccatcgcccgggtaatattttcgggtttagcccgtattcgatgatgaacctggtgggtacgctgtgcgtgtacgcggccatctgcaaacatgaaggcgtgcccatgaagtttccaggaagtaaaattgcgtgggaaggctatagcgattgctcggacgccgatctgattgcggaacatcagatctgggcagccgtggatcgttttgcaaagaacgaggcattcaacgtatctaacggtgatgtcttcaagtggaaacacttctggaaagcgctggcggaacatttcggcgtcgaattcgtggagtatgaagaaggtggtgaggaagtgaaactcgaagaacttatgaaagataaggggtccgtgtgggacgaaatcgtgcgggagaacggcctgacggtgaccaaattagaagaagttggtacctggtggtttagcgatctaattcttggcggtgaatgctccctggactctatgaacaagtctaaagagcacggcttcttaggttttcgtaattcgaagagcagcttcgtctcatggatgtacaaagtgcaggcctgcaaaattgtgccg

SEQ ID NO: 1241 - DNA, 1167 bp, Helianthus annuus
atgagttggtggtgggcaggtgcaattggtgcagcaaaaaaaaaactggatgatgaagatgccccgccgaaataccagagtgtggccctgattattggcgtgaccggtattgtcggcaactcgttagccgagatcctgccattgtctgacaccccaggcggtccgtggaaggtttacggcgttgcccgccgcccgcagccgcagtggaattcagaccatccgattgagtatatacagtgtgatgtcagtgatccagatgaaacccttacaaaacttgggtgtctgcaggatgttacccatcttttctatgtaacctgggccaatcaggccacagaaagtgaaaattgtgaaattaatggcaaaatgtttcaaaacgtgctggacgctgttattccagactcgccgtcattgcaacacatctgcctccaaactggcaaaaaacattactggggcccgttcgagttatatggcaaagccagtcacgatacgccgtatcacgaagatttaccgcgtctggatgttccgaatttctactataccctagaggatattctctttgaaagcgttggacgcaaggaaggcctgacctggagcattcaccgaccgggtttgatcttcggttttagcccctactcactgatgaacctcatcggtgccctgtgcgtgtacgccaccatttgcaaacatgaaggcgtcccgctgaaattcccgggaactaaagaagcgtgggagtcctatcatgactgcagcgatgcagaccttatcgccgagcagcatatttgggctgcggtcgagccccatgcgaaaaatgaagctttcaacatatctaatggcgacgtgtttaaatggaagcacttatggaaagtactggctgaacagttcgaagtggagaacggtgggttcgatgagggcggtgagcgcgtatcactcgtcgaaatgatgaaagataaaggcggtgtctgggatgaaatcgtgcgtgaaaagggcctggtgtcaactaagctggaagaggtagcggcttggtggtttgcggacgggatgctaggcattgagggcgtattggataccatgaataaaagcaaggaacatgggtttttcggcttccgcaatagcaaatcgtcgctggtctcgtggatcgagaaaatgaaaggttacaaaatcgttccc

SEQ ID NO: 1242 - DNA, 1170 bp, Genlisea aurea
atgtcatggtggtgggccggggccattggtgctgccaaaaagaaactcgatgaagatgatgccccacccaaacatcagagcgttgctctgatcatcggtgtaacaggcatcgtgggcaacagcctggccgaaattttgccgctgtcggacactccgggtggtccgtggaaagtgtacggtgtagcacgtcgcccgcgccctccgtggaacgaggataacccgattacttatatccagtgtgacgtttccgatcccgaagacacccaggcgaaactttccccgctgtccgatgttacgcacctgttctacgccacctgggccaacaaatcaacggaagccgaaaattgcgaaataaactctcgcatgtttcagaatgtcttagactgtataatccctagtagcccatccttaaagcacatttgtctggtcaccggccgcaagcactatatagggccgttcgaaagctttggcaagatagaaccgcacgatccgccattcaccgaagatcttccgcgcctggaccacattaatttctattacgaccttgaagatatcctctttgaacaagtaaaaaaaaaagaaggcctgacttggtctgtacatcgcccgggcacaatcttcgggttctcaccgcacagtatgatgaatatcgtgggcacgttgtgtgtgtataccgccatttgcaaacatgaaggtgtgcctctccgctttcccggcgtgaaagctgcctgggaaggctacagcgattgtagtgattcagatctgatcgcggagcatcagatctgggcagcggtggacccttacgccaaaaacgaggcgtttaatgtgagtaacggagacgtgtttaagtggaaacacttatggaaagtgctggccgatcaattcggtgttgagaatggtggcttcgttgaagagggtgaacgtgcgactctggcggatctgatgaaagataaaggcccggtgtgggacgaaattgtgcgtgaaaacggcctgttgccttgcgaactgaaggacgttggactgtggtggtttgttgacttaatgctgggaggcgaggctcttttagattctatgaacaaaagcaaagagcacggttttctgggttttcgcaacagcaagaattcgttcgctagttggattgataaggtgcgcgcctacaagattgtcccg

SEQ ID NO: 1243 - DNA, 1053 bp, Arabidopsis thaliana
atgagttggtggtgggcaggagccatcggtgcggccaaaaagaagctggatgaggacgaaccgtcccagtcgtttgaatcagtggcattgattatcggagttacaggcatcgtaggtaacagcctggcggaaatcctgccgcttagcgatacccgctcgaagttaagccccctcacggacgtgacccatgtattttatgttacctggaccaatcgcgaatctgaaagcgagaattgtgaagcaaacggttctatgttgcgtaacgtgctgcaggccattattccgtacgcccctaatctgcgccatgtctgccttcagacaggtaccaagcactacctgggcccgtttacgaacgttgacggaccgcgtcacgacccgccgttcactgaggacatgcctcgtttgcagattcagaacttttactatacccaggaggatatactgttcgaagaaatcaaaaaaatcgagaccgtcacgtggtccatccatcgtccgaatatgatttttggttttagcccctacagtctgatgaacatcgtgggcaccctctgcgtgtatgcagccatttgcaagcacgaaggtagccctctcctatttccgggcagcaaaaaggcatgggagggctttatgactgccagcgatgcggatctaattgcggagcagcagatttgggcggcagtcgatccgtacgcgaaaaatgaagcattcaactgtaataatgcggatattttcaaatggaaacatctgtggaaaatcctggcggagcagtttggtattgaagagtatggatttgaagaaggtaaaaaccttggtctggtagaaatgatgaaaggcaaagaacgagtgtgggaggaaatggtgaaagaaaaccagttgcaggagaaaaaattagaagaagtgggcgtatggtggtttgcggatgtgattttaggcgttgagggcatgattgacagtatgaacaaatctaaagaatacggtttcctgggctttcgcaatagcaacaatagctttatatcgtggattgacaagtacaaagcgtttaaaattgtcccg

SEQ ID NO: 1244 - DNA, 1170 bp, Lupinus angustifolius
atgagctggtggtgggcgggtgccattggggcggccaaaaaaaagctggacgaagaagaagcccccccgacttcgtttcagaatgtgggtctggtcataggtgtgacaggtatcactggcaactctctggccgaaatcttgccgctcgccgatacaccgggtggaccttggaaagtctatggcgtggcacgccgtcctcgtccttcttggaacgcggatcaccccattcagtatatccaatgcgatatctcagatccgaatgacacgcagagcaaactgtcagtgctgaccgatgtgacccatgtgttttatgtcgcgtatacgaatctgcctacggaagcggaatcgtgtcaggttaatggtgacatgctgcgtaatgtgctgcgttcggtcatccctaacgcgccgaatttacgccatgtttcgcttcaaaccggctgcaaacactacattggtccgttcgaattaattggaaagattaaatcacatgaacctcctcacaccgaagatttaccccgacttgatgccccgaatagttactacactcaagaagacattctgtttgacgaaaccgaaaagatcgaagacctgacctggagcgtgcatcgtccgcagatcatcttcggattttcgccgtattcgtccattaacgtgattcgcaatctgagtatctatgccgcgatttgcaaacatgaacgcgtccctcttaaattcccggggactaaagatgcatgggagtgctatgcaattgcgagcgacgcagatcttatcgccgaacagcatatttgggctgcggtggatccttacgccagaaacgaggcatttaactgttccaatggagatctgtttaaatggaaacacatgtggcctgtgctggcagaacagtttggcattgaagattacggctttgaagaaggctctaaactgaaattaagcgaattcatgaaagataagggatctgtgtgggacgaaattgtgaaggagaatcagttgctgcctatgaaattagaggaagtatcagattggtggtttttggatctgctgtttagcatcgaatcaccgatggatagtatgaacaaaagcaaagaacacggttttctgggatttcgcaatagcaaaaactcctttatcacttggattgacaaggccaaaacatacaagattgtgccc

SEQ ID NO: 1245 - DNA, 1215 bp, Ananas comosus
atgtcatggtggtgggcgggagcaattggcgcggccaaaaaaaagttggatgagaatgcggaggccgcggcggcggcagtgccgacacgctacgagtctgtaggtctggtagtgggtgcgaccggtattgtgggcacctccctgttagaaatcttaccgctgagcgataccccggggggtccgtggaaggtatatgcggtcagccggaacccgcgcccgtcctggtctccaccgatttgcgatggaccgagcgtagaacatgtgcaatgtgacctgtcagacccagacgacgcggcggcgaaactgtctccgctggcagacgtcactcatgtgttttacgttgcgtggacctcacgtccgagtgaagatgagaatcgggcagcgaacaccgcaatgctgcgcaacgcgttaagcgtgttagtgccggccgcaccgaatctgcagcacgtttgtttgcagacggggcgcaagcattatgtcggaccgtttgaagccctgggccgtgtaccagcccatgatccgccgttccacgaagatctgccgcgcctggatgtgccgaacttttattatgacttagaggatgcgctgctggatgaactttcgaaacgcccatcctcctcatccccggtgagctggagtgtacatcgtcccagcgtgatttttggcttcagcccgcgtagcgcaatgaacctggtggaaaccttgtgcgtatatgcggccctttgccggcgggaaggggccaaactgaggtggccgggcggccgcgtcgcgtgggagggctttagtgatgcgagcgatgcggatctggtggcagaacatcagatatgggcagccgtggatcctttcgccaagaacgaggcctttaattgcagcgacggcgacgtgtataaatggaagcacctgtggccgattctggcggaccagtttggcgtggattgggtggggtatgaaggtgaggagaaacgctttaaactagccgaagcgatggagggcaaagaacagctgtgggccgaaatggtcactgaacacgagttgaccccgacgcgcctggacgaggttggtaattggtggtttgccgacattatgtttggctatgacgctgaacatctggatagtatgaacaaatcgaaagaacatggtttcctgggatttcgtaatacggtcagttcgtttaacacctggatcgacaaaatgaaagcgtataaaattgtgcct

SEQ ID NO: 1246 - DNA, 1185 bp, Beta vulgaris
atgtcatggtggtgggctggcgcgattggagccgcgaaaaagaaactcgaggattcggacgacgtgtcgactacctcaattaactatcaaagtgtagcactgatcgtgggcgttaccggtatcgtgggcaattcgttagcagaaattctgccgttaagcgataccccgggcggaccatggaaggtttatggcgtggctcgtcgtcctcgcccaaattggaatgccgaacatccgatcgaatacatccagtgcgacatctccgataaagatgatgtagtactgaagttgagcccgctaactgatgtgactaacatcttttatgtttgctgggcaaactgtgtgaccgaagcggaaaactgtaagattaactcgatgatgttccaaaacgttttgaatgctgtcgtgccgaacgcgcctaatctcaaacatatctgtttgcaaactggcatgaaacattataccggtgccttcgagtattgggggaaagtggaacaccttttagatcctccttactcggaagacatgccgcggcttgaactacctaacttttattacgatcttgaggacattctttacgcgcaagtggcaaaaaaggaggatatcacctggtcggttcatcgtccgggctgtatttttggattcagcccgtacagcgtcatgaacgtgcttggcacattgtgcgtttatgcggcaatatgtaaacatgaaggcatcccttttcggttcccgggatccaaaattatctgggagtcgtactcgcaggcctccgatgctgatttaatcgcggaacaccaaatttgggcggccgtggatccttacgcgaagaacgaagccttcaattgctctaatggcgacgtctttaagtggaaacatctttggcaagttctgggagagcagttcggagtggaagtagcagagtttgatgaacgagttggggggttttcactggcggagtggattaaaggtaaagattcagtatgggaagaaattgttaaagaaaatgacctggtggcgaccaaactggaagaagtgggcacctggcagtttgtggatatggcgtttagctggaactggcccttagataccatgaataaatccaaagaacatggatttttaggttttcgaaatacaaaaaatagccttatttattgggttgataaaatgaaagcctacaagattgtcccc

SEQ ID NO: 1247 - DNA, 1182 bp, Gossypium raimondii
atgtcgtggtggtgggcaggggccattggtgccgccaaaaaaaaattagaagaagacgagacaccgaaatccttccagagtgttgccttagttgttggcgtgacaggtattgtaggcaacagcctggcggaaattctgccactttccgatactccgggtggtccttggaaagtgtacggcgtggctcgccgtccgcgtccgcattggcatgcggaacatcgcatcgaatatattcagtgcgatgtgagtgatccgaaagatactgaatctaaactgtcccagcttacggacgtgactcacattttctatgttagttgggtcaatcgcacgacagaaacagataactgcgagataaacggttctatgctgcgtaacgtcttacacacccttattcttaatgcgccgaacctgcgtcacatttgtctacagacaggcgccaaacactatgtgggctccttcgaatatattacgtcgggtaaaatcgaaccgcatgatcctccgtttactgaagacttgcctcgcctgaacacaccgaatttcttctatgttcaggaagatatcctactgcaagaaatcgagaaaaagcaaggcctgacatggtccgtacaccgtcctaataccatctttggcttctccccgtacagtcttatgaatatcgttggcaccctgtgtgtgtatgccgctatttgtaaatatgaaggtaaaccgctactgtttccgggcaataaagttacgtgggaaagctattcggaagtcagcgacgcagaccttatcgcggaacaccaaatctgggccgccgttgacccttacgcgaaaaacgaggcgttcaatgtaaacaatggggacatcttcaaatggaaacacttgtggaaagttctcgctgaacagtttgggattgaaaaatatggtcttgaggaagggaaaaatgtaggccttaaagaaatgatgaagggaaaagaatctgtgtgggaaaagatagttaatgagaaaggactccagaagacgcgcctggaggaggtaggcttttggtggttcgttgatatcctgttaagcatgatgcccatggagtccccgattttatgtatgaacaaatccaaagagcatggtttcctgggctttcgcaattcaaaaagctctcttatcacttggatcgataaaatgaaagcctttaaaatcgtccct

SEQ ID NO: 1248 - DNA, 1170 bp, Citrus sinensis
atgtcgtggtggtgggccggcgccataggggcagcgaaaaagaaacttggtgaagatgacgaacgcaacgtggggttagtgattggcgtgacgggcattctaggcaatagcctggcggagatccttccgcgccctgacacgcccggcgggccttggaaagtgtacggcgtggcgaggcgcccgcgacctcattggaacgccgatcatcctattgaatatattcagtgcgatgtgagcgatccgcagcaaactcagactaaacttagccagctgaccgatgtgacccacattttctatacgacgtgggcctcgagtcctacggaagtggagaattgccagattaacggtgcaatgctgcgtaacgtcctgcattcagttattccgtctgccccgaatctccgccatatttgcctcgttacgggtgcaaaacactacttaggtccgtttgaagtggcaactcgccgaatgaaatcccacccgctagaaccgccgtttactgaggatctacctcgtctgaacatgccgaacttttactatacgcaagaggatattctttttgaagaggtcgaaaaacgggagggtctgacctggagcgtccaccggccacacctggtgtttggttttagtccatatagcttgatgaatgtagtgggcaccttgtgtgtttatgccgccctgtgtaagcacgaaggcattcctttgttattccccggcactaaggattgttgggaggggttctcggtggcaagcgacgcggacttaatcgccgaacaacaaatctgggcggttgtggacccccgcgcccgcaacgaagcctttaactgttctaacggcgacgtgtttaaatggaaacacctgtggaaggtgctagcagagcgtttcggcattgaaaaatatggctttgaagagggcggtgagaccgtgcgcttggaagagatattgaagggaaaggaaagcgtatgggaagaaattgtgaaggaaaaccagctgcgcccgactaaacttaatgaagtggcggcgtggtggattgccgatgtcacgtttgacatcggggcgggaatgctggtgtccatgaacaaaagcaaagaatatggcttcttggggttccgtgacagcaataaatcttttgcaacttggattgaccgtttaaaacattacaaaatcgttcct

SEQ ID NO: 1249 - DNA, 1167 bp, Amborella trichopoda
atgagctggtggtgggcgggcgcgattggcgcagcgaaaaaaaaaaacgacgaggatgaaggcccagtgaaatatcagtctgtggccctggtagtgggcgtgacggggattgtaggcaactctttggccgaaatcctgccgctgagcgacacacctggtggcccctggaaagtctatggcgtggggcgtcgcccgtgcccaaagtggtctgaagatcatccgatcgaatacattcagtgcgatattctgaaccttgaagaaaccaccgcgaagcttagccctctgaccgatattacccacgttttctatgtaacatgggcagatcgtatttccgaggcggagaattgtgatgtgaacggccacatgttccgcaacgtgctggacgcgttactccctaacgcaccgaacttgcaacatatttgtttgcaaaccggtcgcaaacattatttaggccccttcgaagcgattggtcacgtcaaaccgcacgaaccgccctaccaagaagacgttccgcgtcttccgtgcctcaatttctaccacactcttgaagacatcctgtttgaagccgcggaaaaaaaagaaggcctgacctggtccgtccaccggccgaccgtgattttcggtttttcaccttatagtttaatgaacctggtaggatcactttgtgtctacgcggctatctgtaagcacgaaggactgccgtttcgctttccgggctcaaaagcgcagtgggagggctttagcgatgcttccgatgctgatttgatcgcggagcagcacatttgggccgccgttgatccgcatgccaaaaacgaagcctttaactgtgcaaatggtgacgtttttcgttggaagcaactgtggaagatcttgggcgaacagttcggtttagaactcgttgagtacgaaggtaagggtttttcgttggtagaagccatgaaagaaaagggcccggtctgggataccatcgtcaaagaaaacgaactgagcgaaacgaagctgcaagaggtggcgcagtggtggtttgccgatgtgatgctggataatgaaggcgtagggttagactctatgaataaagcaaaagaacatggttttctgggtttccgtaataccctgacgagcttcagttcgtggatcgataagatgaaagcgcataaaatcgtgccg

SEQ ID NO: 1250 - DNA, 1236 bp, Musa acuminata
atgtcttggtggtgggctggagccattggcgccgcgaaaaagaagacaacgggcgacgatgcagatgcaccggcggcgcgctatcagagcgtcgcgctggtggtgggagcgaccggtatcgttggctcgagtctctatgatattctgccgctagccgatactccgggtggtccctggaaagtgtacggcgtgtcgcgtcgccctccgcgcccgagtcttctttcaccgaacattgcggatggcgtaggcctgccggttgtgcacgtcccatgtgatgttgcggatccggcggacgcgctggcaaaattgagcccgctaggcgatgtgacccacattttctatgctgcatggtgccgtcgctcaaccgccgccgaaacccgggccacgaacgcggccatgctgcgtaatgtcctggacgccgttctgccggcggcgccgaacttgcagcacgtgtgcttacaaaccggtcgcaatcattatctgggtccgtacgggccggccggcggtgtggtggccgaagtaggtccccgtcacgatccgccgcatgacccgccgtttccggagaataccccccgtttggcgatacccaacttttactacgaactcgaagatgtgctcctggaagaattggccaaaaaagaacgtgccgttacgtggtcggttcatcgcccaactaccattttcggcttttcgccgtgcagtttgatgaatttagtgtgttcactgtgcgtgtacgcttccatttgccgtaaagaaggcgttccgctgcgctggtttggctccgaggaagcgtggtatggtttttcggacgcgagcgacgcagacctggtagcggagcatcaaatttgggcagcagttgatccctatgccaaaaatgaagcgtttaactgttcaaacggcgatgtgtttaagtggaaacatctatggcccgtgttagcagaacagtttggcgtgccagcggttggttacactgggtacgacggtcgtttcaagctcgaagatgccatgaaaggcaaggaggcggtgtgggaagatattgtacgagaaaacgaattagttccaaccgcgctcgacgaagtgggccattggtggtacgccgatgccgttttaggtttagagttcgaacatctcgataatatgaataaaagtaaagaacacgggtttctgggttttcgcaattccgtcacgtcgttcaatacctggattgataaacttcgtgcgtacaaagttgttcct

SEQ ID NO: 1251 - DNA, 1068 bp, Zostera marina
atgagctggtggtgggcgggtgccattggagcagcgaaaaaaaaagtggacgatgatgaagcggaaaccgaaaggatcccgatccgttacgagtcagtaggcttagtaattggtgcgacggggattgtaggcaatagcttggtggacattttaccgttaccagatactcccggtggaccatggaaggtgtatgcagtggcgcgacggccgcgcccgacgtggaatctgaccgatcaccccgttgaatacattcagtgtgatgtttcagacgtaacggacgtccaagccaaattatctcctctaacggacgtcactcatattttttacgtgacccgcgccccgggaaaaacagaggaagagaactgcgcggtgaatggtcagatgcttagaaatgtgctggatgccgtgattcccaatagcgtgcgcctgcaacatatttcactgcagacagggcgtaaccactacgtgggtccgcctgaactgtcagatgaaattgaaattcacgatcagccgtatcatgaagaactgccgcgactgaacggcccgaatttttattatacgcaggaagatatcctggcccggtacgagggtgttccgttccgatttccgggcggcaaacatgcctgggagggtttctcggatgctagcgacgcggatctgatagccgagcatcaaatttgggccagtgtggacccgtatgcgaagaacgaagcttttaactgctcgaatggcgacatttttagctggaaggtgatgtggaaagtgttgtctgaacagctggagcttgaatgtgttggttacgaaggtgaagagaagcgcttttcacttgaggaagctatgaaaggcaaagaaggtatttgggaagcaatggtgaaagaaaatggcctgtctgaaacttctctaagcgaggtgggtaattggcagttcgtcgatcgctgcctgaattctgaaaagacccacttagattcaatgaataagtcaaaagaacatggcttctccggcttccgcaactctattaactcactgatttattgggttgataaggtgaaaacgtaccgcattgtgccg

SEQ ID NO: 1252 - DNA, 1167 bp, Cephalotus follicularis
atgagttggtggtgggccggcgcgatcggtgccgcgaaaaaaaaatatgaagaagatgaacaaccgcgctcttaccagagcgtgggtctcgtcgtaggtgttaccggcattgtgggcaatagcctggccgaaattctgccgctgtcagacacgccgggaggcccgtggaaggtctatggtgtggcgcgcaggccgcgaccggattggaacgcggaccaccctgttgattacatacagtgtgacgtgagcgaccccaccgaaactcagagtaaactctcgaccctcaccgatataacacatatcttttacgtgacatgggcgagtcgtagtacagaggtcgaaaactgcgaagtgaacggcgcaatgttccgaaatgttttacgcgccgtgatccctaatgcaccgaacctacgccatatttgtttgcagaccggcggtaagcattaccttggccccttcgaattatttggcaaaattcaggctcatgacccaccgttcaccgaagatctgccgcgtttagatgcgccgaatttttattatacgctggaagacgttctcttcgaggaagttgaacagaaagaagatgtgtcttggagcgtccatcgcccgggcgcgatttggggattctcaccgtatagcttgatgaatatcatcggcaccctgtgtgtttatgcggccatttgcaaacacgaaggtaaaccgatgttgttcccgggtagcaaggcggcctgggaatgttacagcattgcatctgatgcggatctcattgccgaacaacaaatttgggctgcggttgatccttatgcccgtaacgaagcgttcaactgctttaacggcgatgtctaccgctggaagcaattctggaaagtgttggcggaacaattcgaaatcgaagaatacggctttgaggaaggtaagaacgtaggcttggttgagatgatgaaaggcaaggaagcggtctgggaagaaatcgtcaaggaaaatcagctgcaagatactaaactgaaagacgtcggtgtatggtggtttgtagacctagccctgggtggtgaaggcaccatgctgtgcatgaacaagtcgaaggagcacgggttcctaggcttccggaattccaaaaacagtttaattaattgggttgataaaatgaaagcgtataaaattgttccg

SEQ ID NO: 1253 - DNA, 1182 bp, Ipomoea nil
atgtcctggtggtgggccggcgctatcggtgcggccaaaaaacgcttcggtgaagaagacgatgcaccaccgaaacaccagagtgttgctctgattttgggtgtaaccggtatcgtaggtaactcattggccgagatcctgcctctggccgacaccccgggcggtccgtggaaagtatatggcgttgcacgacgtccgcgtccagcgtggaatgcggatcaccctatccagtacatccaatgtgacattagcgccgaggaggatgcccagagcaagctgtcggtgctgaccgatgttacccacgtattttacgttacctgggcacatcgcccgaccgaacttgaaaactgtgaagttaaccgaaaaatgctcggcaatgttttaaatgccgtagttccgaactctccggatctgaaacatatttgtctgcagaccggtcagaaacactattggggcccgttcgagttgagcggtaaactttcacacgatcctccgcatcatgaagatctgccgcgcctggacgccccgaacttctattatgttctcgaggacttgctgttcgatgaggtcaaaaaaaaaaaggaagagggcttaaccctgacatggtccgtgcaccgccctggaaccattcatggcttctccccttatagcatgatgaacattgtaggcaccctatgcgattacgcggcgatctgcaagcacgaaggggccccactgcgcttccctggaatcaaagacagctgggatggatacagtatttgctctgacgccgatctgattgctgaacaagagatttgggcggcggtggatccttatgcgaagaatgaggcgttcaacgtgagcaacggcgatgtcttcaaatggaaacacctgtggaaaatattagcggaacagtttgaggtagaagcaggtgaattcgaagaagaaggtgaacgtctgacgcttcaagaaatgatgaaagaaaagggcccggtgtgggacgaaattgtcgagaaaaacaaccttcagcccaccaagctggaagatgttggcgtttggtggttcgcggatgtcattcttgggatttgttacccgttagattcaatgaataaaagtaaagagcacggtttcctggggttccgcaatactcataaagcgttcatctcctggattgatgaaatgaaagcccataagatcgtcccc

SEQ ID NO: 1254 - DNA, 1173 bp, Ricinus communis
atgtcgtggtggtgggcaggcgcgattggtgcagcaaaaaaacgtgtcgaagatgacgatccgcaaccgaaataccagtcagtggcgttgattattggcgttaccggtatcgtgggaaattctctcgcggaaattctgccgctggctgacactccgggcggtccatggaaagtgtatggcgtggcgcgacgccctcgtccgatctggcaggctgatcacctgatcgaatacattcaatgcgatgttagcaacgaagaacagacactggagaaactgagcactttaaaggatacgacgcatattttctttgtcgcgtgggcgagtgaaccgaccgaagcggaaaattgcattgtgaacggtaccatgctgcgcaacgtgcttcgagcagttattccgaatgccgaaaacttgcagcatgtgtgcctgcaaaccggtcgcaaacattatgtaggcagctttgaatcaatctggaaaatcccaagccacgaaagcccctttcacgaagatcttcctcgccttaatgacattaacttctactataccttagaagatgttctgtttgatgaaactcagaaaaaggaaggtttaacgtggagtattcatcgcccgggcgttatttttgggtttagcccctgcagcctcataaatatggtcggtaccctttgcgtgtatgccgcgatttgtaagcaccaaggcctgccgttaacctttcctggcaacagagacgcttgggatggttactgggatgccagcgacgcggatctgatcgccgaacaccaaatttgggccgcggtggatccatatgcaaagaacgaagcgttcaattgcagtaatggtgacgtattcaaatggaaacacctgtggaaggaactagccgaacagtttgaaattgaaaattacggcttcgaagaagaaaacgataaacgtccatctctggtcgagatgatgaaaaacaaaggcccagtatgggacgaaatcgtcaaagaaaaagaactgctaccgacgcgtctggaggaagtggccgccttctggttagtagatctcttgttgcagggcgcgtcgctcttggatagcatgaataaatcgaaggagcatggattccttggctttcgtaactcgaacaaatcgtttgcaagctggatcgacaaactcaaagcacagcgcattgtgccg

SEQ ID NO: 1255 - DNA, 1200 bp, Elaeis guineensis
atgtcgtggtggtgggcaggcgcgattggtgccgcccgtaaaaaatttgatgaagacagcggaggcgggggagccgcggctaaatttccgtccgttggtttggtaataggagttacgggtattgttggtaatagcctggcggaaattctgccgttagccgacacgccgggcgggccttggaaagtctacggagtatcccgccgtccacacccaagtagcctggcgagtcaaacagagggcttggcgattgaacacgtacaatgtgatattagcgatcgcgaagacgccctggcgaaattgtcaccgctgaccgatgtgacacacattttttatgtagcctgggttaaccgttcgaccgaagcggaaaaccgcgagatcaacagcgccatgctgcgcaacgtgctgaccgccgtgatcccgaatgcgcccaatctccagcatgtatgcctgcaaaccgggcgcaaacactatctgggaagctttgagtcgttaggcaaagtcaagggtcatgaacctcctttcgtagaagatttacctcgtctggattgcccgaacttctactatgatctcgaagacattctgttcgaagaggttgcaaagcgtgaaggtgccgttacatggtcgatccatcgcccaaccaatatttttggattcagtccatcaagcttaatgaatctgatgggtatcctgtgtgtttacgccgcaatttgccgccgcgaaggcgtgcctctgcggtggcccggcagccgagttttgtgggaaggcttcagcgacgctagtgatgccgacctcattgccgaacatcagatatgggccgcggtggatccgtacgccaaaaacgaagcgtttaactgcagcaacggcgatgtgtttaagtggaagcatttgtggccgctcctggcgaaagagttcggggtggaatgggtcgggtaccagggcgaggaagcccgctttaaattggaggatgccatgaaaggcaaggaaggcctttgggaaaaaatggtggcagagcatgaattagcccccacgcgtcttgaacaggttggcaattggtggttcgccgatgttgtgctgggcttggaagaagaatacttggattccatgaacaaatccaaagagcacggttttttgggctttcgcaataccgtgacgagcttcaactcgtggattgacaagatcaaagcgtacaaaatcgtgcca

SEQ ID NO: 1256 - DNA, 1200 bp, Citrus clementina
atgtcttggtggtgggcgggtgcaatcggcgcggcccgtaaaaagttcgaagaggacgaacccgcgcgctcatatcagtcggttgccctgattgtgggagtcaccggtattgtaggcaacagcctggcggaaattctgccgctcccagacaccccgggcgggccgtggaaagtctacggcgttgcgcgtcgtcctaaacccaattggaacgcggaccacctcgtggaatatgtgcaatgcgatgtgtccgacccggaagaaactcaggctaaactgagccagctgacggatgttactcatatattctatgtaacctggaccaatcgttcaacggaagcggaaaactgcaaaatcaacgggagcatgttccgcaatgtactgcgcgcagtgattccgaacgcacctaacctgcgtcatgtttgcttgcagaccggtaccaaacactatctgggcccgtttgaagcgtttggcaaaattaaaccttacgacccgcccttcaccgaagacatgcctcgcctggacgcgcctaacttctactatacattggaagacattctgtttgaagaggtggaaaagaaagaggaactcagttggagtgtacaccgcccggataccatcttcggcttttcaccgtatagtctgatgaacttggtcggggccttatgtgtttatgccgcggtgtgcaaacatgaaggtattccgctgcgcttcccaggtaccaaagcggcctgggaatgctatagcatcgctagcgacgccgatcttattgcggaacatcagatttgggcagcggttgatccgtacgcaaaaaatgaagcatttaattgtaacaacggagacgtgttcaaatggaagcacctttggaaggtcctggcagaacagtttggaattgaagattatggcctgtcagaagaagaagaagaggaagaggaaggaggcggtggcacccagagggtgaagctcgcagaatttatgaaagggaaagaaggcgtatgggaagagatcgtccgcgagaatcagctgcagccaacccgattagatgaggttggtgcgtggtggtttgtggacctggtacttactggtgaggcgaaactggcgtcgatgaacaaaagcaaagaacatggcttttcggggttccgcaatagtaaaaatagcttcatcacctggattgataaagctaaaggctacaaaatagtgccg

SEQ ID NO: 1257 - DNA, 1230 bp, Musa acuminata
atgagctggtggtgggcaggcgcgatcggtgcggctcgtaaaaaactggaagacgattcaagctctaccgtgccgaaatatgaaagcgttgccattgtgataggtgccaccggcattgttggaacttccttagtggatatcctgcccttagctgatactccgggcggtccttggaaagtgtacgctgttagcaggcgtcccccaaacagtgcaatcctgccgtactcgtacagtcctgccgacgctgaagcgccggtggcggcggatacactgcgcgtgcagcatatccagtgcgatgtgcttgacgcggctgatgcagtagccaaactcagtccgctaacggacgttacgcacctgttttatgtagcttgggccaaccgcttgaccgaggctgaaaaccgcgtggtgaattccgccatgctgcggaatgttctgagcgccgtggtaccttcagcgccgaatctgtgccacgtgtgtttgcagaccggacgtaagcactacgttggaccctttgaagccgtcggcaaagccctggcgcacgatcctccgttccgcgaagaccttccccgcctgccggtgccaaacttctactacgaccaggaagatattttgttcgacgaactgagcaaaaaagagggtgctgtaacctggtcaatccaccgtcccacaactatcttcgggttctcgccgacctcgttgatgaacctgattggtaccttgtgtgtttatgctgctatctgccgcaaggaaggcgcgccgttgaagtggttcggaagccgtacaacctgggacgggttcaacgatgcatcagatgcagatctgatcgccgaacaacaaatatgggcagcggtggacccgtatgcgaaaaatgaagcctttaacatttcaaatggggacctgtttaaatggaaacacttgtgggcggccttagcggaccagttcggcctggaaagcgtcggttacgaaggcgaagccagccgctttaagttagaagatgccatgcgcggtaaagaggctgtgtgggcggaaattgtggccgaaaatgagcttgtaccgacaaaactggaggaagtcgcctcctggtggtttgcggacgttgtgttggggctggagctggcgcatcttgatagcatgaacaaaagcaaagaacatggctttttaggctttcgcaacacggttgcctcgtttaattcatgtattgacaaaatgaaagcgtttaaaattgtgccg

SEQ ID NO: 1258 - DNA, 1170 bp, Theobroma cacao
atgtcgtggtggtgggcgggcgcaattggcgccgcccgtaaaaaactcgaagaacatgatgaaccatcaaaatacaagagcgttgctctggttatcgggatcactggtatcgtgggctcctccctggcagaaattctgccgttttccgatatcccaggcgggccatggaaggtctacggtgtggcgcgccgaccgcggccggcatggaccaacgcgttgcctattgactacattcaatgtaacatatcgaatgaggaggagacgcaagaaaagttatccaagctgaaagacgtgacccatattttctatgtcgcgtgggctaagaaatcatctgaagccgaaaactgtatggtcaatggcacgatgctgcggaacgtactgaaagccgtgatcccaaacgcgccgaaacttaagcacgtgtgtctgcaaaccggtcgccgccactatacaggtccgttcgacagcgtgggcaaagtccagcctcatgacccgcccttccgcgaagatttaccgcgcctgccggttctgaatttctgctataccctggaagatgtactgttcgaggaagttaaaaaaaaagatggcctgacctggtctgtgcaccgcccgggcgtcatttttggatttagcccctgctcactaatgaacattgtcggaagcctctgtgtctacgcggcaatttgcaaacatgagggtaaacccctccgcttcccgggttctcgccaggcatgggacgggtactgggatgcctccgacgcggatctcattgccgagcatcagatttgggcagccctcaatcgccatgcgaagaatgaagccttcaactgtagcaatggcgatgtgttcaagtggaaagatctgtggaaagttctggccaaacagttcggcattgaagactatggttttcatgaaagcgatgagcgccactcactggtagaaatgatgaaagacaagggaccgctgtgggatgaaattgtgcgcgagaaaggcttagtcccgaccaagctgaacgaagtaggcgcgtggagatttgcggacgcagtactgtcaggcaaatctctcctggattcaatgaataaatccaaagagcacggcttcgtgggctttcgtaactcgaaaacgtcgtttaacagctggattgataaaatgaaaacccataaaatcgtgccg

SEQ ID NO: 1259 - DNA, 1164 bp, Gomphocarpus fruticosus
atgagctggtggtgggccggcgcaataggcgcggcgcgtcaaaagaaaaccgacgactacaccgctctgactaaatttcagtctgtaggcctgattattggggtaaccggtatagtgggtaacagtctggcagagatcctgccactgagtgatactccgggaggtccctggaaggtttacggtgttgctcgccgtccgaggcctgcctggaatgcggatcatccgattgagtatgtgcagtgtgacatcgcgaaccgcgaggacaccgaagaaaagctttcgaaacttacggatgtaacccatgtgttttacgtgacatgggcgaataagtcgaatgagattgagaactgcgaggtaaatggtaagatgcttaaaaacgtgttggacgtcctagttccgaactgtccgaaattgcagcacgtttgtctgcaaaccggggggaaacactattgcggaccgttcgaactgtatgggaaagttggtcacgaacccccatttactgaggacctgccgcggctggatgttccgaacttttattataccctagaagacgttctcttcgaagcagtgggcaaaaaagaaggactgacctggagcgttcaccgccctggcaatatttttggcttttcgccgtacagcttgatgaatctggtaggcactctctgtgtgtatgccgcgatttgcaaacacgacggtgtcccgctgaaattcccggggtgcaaagaggcatgggaaggttatagcgtgtgcagcgatgctgacttgattgccgaacaccagatttgggccgcagtagacccgtttgcgaagaatgaagcgttcaatgtgtccaacggcgacgtgtttaaatggaaacatttctggaaagtgctggcagaacagtttgacgtagagtgtggtgagtatgaaggcgaaaaattgagtcttgaggatatgatgaaagataagggaggcgtctgggatgaaatcgtggcggagaacggtctggcgccaaccaaactggaggaggttggtctttggtggttcggcgatatttgccttggttatgaatgtgcactgatgtcaatgaataagagcaaggaacatggcttcctgggcttccgaaacagcaaaaacgcgtttatttcttggattgaaaaaatgaaagcctacaaaattgtaccg

SEQ ID NO: 1260 - DNA, 1173 bp, Lupinus angustifolius
atgagctggtggtgggcaggcgctattggtgccaacaaaaaaaaatcgaatgaggaagaggaagagccgcccacgagtttcaacaacgtcggcctggtcataggcgttaccgggattgtgggtaacagtctcgctgagatcttgccgcttgccgatactccgggcgcgccatggaaattgtacggtgtggcgcgtcgccctcgcccgccctggaacagcgggcacagcatcaactatattcaatgtgatatttctgaccctgatgatgcgcagagtaagctatcggttttaaccgacgtgacgcatattttctatgttagctggagccagcaacctactgaagccgaaaactgcaacgtaaatggtgccatgctgcgcaatgtgttaacgtcagtgataccgaacgctccgaatctgcgccatgtgagcttgcagactggcgcgaaacactatctggggccgttcgaacttttcggcgaaatcaacccccacgatccgccgttcaccgaagatcttccccgtctagaagtcccgaatttctactacacacaggaagatattctgtttgaagaagtcaataaaaaagaaaatctgacctattcgatccaccgcccccattttatttttggattcagcccgtatagttttatgaacctgattggcacgctgtgcgtctacgccgcgatctgcaaacatgaagggctgccgcttaaatttccggggacaaaagaagcttgggaatgctattcaaccgcatcagacgccgatctgattgccgaacagcatatttgggccgccgtggaccccaacgcccgtaacgaggcgttcaactgtagtaatggcgacgtatacaagtggaaaaatctttgggaagttttggcggaacagtttgaaattgaagaatacggcttcgaagaaggctgtgacttgcgtcttgaagagcttatgaaggacaaaggtcacgtgtgggacgagatcgtaaaggaaaacgaactacttccgaccaaattggaggagatcggtgaatggtggtttagtgacctgatgttagggatggagcccgttctggatagtatgaataaaagcaaggaacatggttttctgggttttcgcaattcgaagaactcgtttattacctggattgataagaataaagcttacaaaatcgtcccg

SEQ ID NO: 1261 - DNA, 1122 bp, Brachypodium distachyon
atgtcgtggtggtgggctggagcgatcggcgcagttaaaaagcgacaagatgagtcagccgcagcggcggaacctagctttcagtccgttgcgcttgtcgttgggagcactggcatcgtgggcacttctttactggacattcttccgctccaggatacccccggcggcccctggaaagtctacgcgctgtctcgtcgcccgttgccaccgtggagcccgcccccgagtcctgcggtgactcatctccatctggacctggctgattcggctgcagttgctgatgccttaacgcctcttaccgatattacgcatgtgttctacgtggcatggagcaatcatccaacagaagcccagaatcgcgaggcaaacagcgcgatgctgcgcaatgttctgagcgtggtagttccaaattgtcccgcgctggttcacgtttgcctccagacgggtcgcaaacactatattggcccgttcgaagccatcggcaagatccccgcaccggatccgccgtacaccgaagacatgccgcgcctggattatccgaacttctactacgatcaggaagacgtgctgtttgatgaagttagtaggcggggtggcgcggtgtcctgcctgtgcgtctatgccgcaatttgtcgtaaagaaggtgccaccatgcggtggcccggcagtaaggtggcctgggaaggcttttcagatagtagcgatgccgatctcattgcggagcacgaaatctgggccgcggttgacccgtttgcgaaaaacgaagcgtttaattgcagtaacggagatctctataaatggaaacagctgtggccgatgcttgccgatcattttgaagttgaatgggctggctacgacggtgaggaaaaccgcttcatgctgacccaggcgatggcaggcaaggaggccgtatgggccgagatcctgcaggagaacgaattaatacgaacggaactggaggaaattacgaactggtggtttgtggatgctctcttcaatgtagaaacccagcatttagatagcatgaataagtccaaagagcacggctttctgggcttccgcaacacaacgaattcgtttaatacgtggattgaaaaaatgaaagttttcaagatcgtgccg

SEQ ID NO: 1262 - DNA, 1188 bp, Oryza brachyantha
atgagctggtggtgggcaggtgcgatcggtgcggtaaaaaaacgtcaagaagagaatgctgcggcaactgaacctagctttcagtcagtggccctggtattaggcagcacaggcctggtcggcacgagcttattagacattttgccgctccaagatactcccggtggtccttggaaggtctacgctgtgtcgcgtcgcccactgcctccctggagccctcctgactccccggcggtcacaaatctacatctagacctcgcggacccggcagccgtggcggaagccctgacaccgctgacagacatcacccatgtgttttatgtggcctggagtccgcaaccgaccgaggcccagaacttagaagtgaacgccgccatgttaagaaacgtgctgtcggtggtcgtaccgaactgcccggccttagttcacgtttgccttcagaccggtcgcaaacactacattgggccgtttgaggcgatcggcaaaattccagtgccggacccgccgtttgcggaagatatgccgcgcctgaactgccccaatttttattatgatcaggaagatgtgctgtttgaagaagtgtctcgccgcgacggtgcggtaagctggagcgtacatcgcccgactaccatctttggcttctcgccgcgcagtgcaatgaatgtggtcggtagtctctgcgtttatgcagctatctgtcgcaaggagggggccgtcttacgctggccgggtacgagagtggcatgggaaggtttctccgatgcgagcgatgcagacctcattgcggaacatgaaatttgggcggccgtagaaccgtttgctaagaatgaagcgttcaactgttctaacggtgatctctacaaatggaagttactgtggcccatgctagccgatcaattcggggtggaatggagcggctacgagggcgaagaatcgtcgtttaaattagaagacgcgatgagtggcaaagaagctgtgtgggccgaaattgtgatggagaacggcctggttgaaacagaactgaaagaaataaccaactggtggtttgtggatgcggtattcggcgtacagtccgagcatcttgacagtatgaacaaaagcaaagaacacggcttcttaggcttccgtaatacggttaatagctttaatacctggatcgagaaaatgaaagtgtttaaaattgtcccg

SEQ ID NO: 1263 - DNA, 1167 bp, Catharanthus roseus
atgtcctggtggtgggccggagcgatcggcgtggccaaacgtaagttggatgattttgacgcgccaccgaagtaccagagcgtgggtcttattctgggcgttaccggaattgtcggaaacagcctggccgaaatcttgccgctttcggacacccctggtgggccttggaaggtttacggtgtagcccgccgtccacgtccgagctggaacgcggatcatccggtagaatacattcagtgtgacatctcggatccggaagatgcacagtccatgttgtcgaaattgacagatgttacccacgtgttttacgtcacgtgggcaagcaaaagcaccgaagtggagaactgcgaagttaactccaaaatgtttcgcaatgtactcaacgcgatcattccgaactgcccgaacctccagcacatatgtctgcagactggcttgaaacattatctaggcccgttcgaactttttggtaaagcggcggtagctcatgaacctccctttcatgaagagcttccgcgcctggacgtccctaacttttattatacgctggaagatattcttttcgaggaagtgcagaaaaaagagggccttacgtggagcgtgcatcgcccgggtaacatctttggcttttcgccattttcgctcatgaacctggtaggcactttgtgtgcatatgctgcgatttgtaagcatgagggggttccattaagatttcccggctgcaaagaggcttggcaagggtacagcatgtgctccgacgcggatttaatagcagaacaccagatttgggccgccgttgatccctatgcaaaaaatgaagcctttaatgtctctaatggcgatgtgtttaaatggaaacatttctggaaggtgttagctgaacagtttggcgcggaatatgccgaatatcagggcgaacggctgtcgttgcaagaattgatgaaagataagggaccggtgtgggaaaacatcgttcgtgaaaacgggctggtgcccagcaaactggaagaagtgggggtgtggtggttcgccgaccttgtcctgtccgttgaatgtccgttagactctatgaataagtccaaggagcatggcttccttggatttcgtaactcaaaaaacgcctttatcagttggattgacaaagcgaaggcgtacaaaatctttccg

SEQ ID NO: 1264 - DNA, 1170 bp, Populus euphratica
atgagctggtggtgggcgggtgctcttggtgccgcaagaaaacagagtgaaaatggcgatacgagccgaggccaccagtccgtagcgttggtggtcggggtaacgggcattgttggaaactcactggcggaaattctaccgttaagcgataccccgggtggtccttggaaggtttatggcgtagcgcgtcgcccacggcccaactggaatttagatcaccctgtggaatacatccagtgtgacatcagcgacacagcggaaacccaagcgaaactgagccaactgaccgatgttacgcatattttctacgttacttgggcactgcggtttactgaggcggagaacattcaggcaaataacctcatgtttcgtaacgtcctccaggcagttattccgaatgcgccgaatttaaaacacgtttgcctgcagaccggactgaagcattatgtgggtccgtttgaactggtgggcaaaatcgaaccacacgacaccccgtacacggaggacctgccgcgtctgaacgcgccgaatttttactacgatttagaagacattctggcggaagaagtggcaaccaaagaaggtgtcacgtggtctgtgcaccggcctcatacaatcttcggttttagcccgtacagcctgatgaacatgatgggaacgctgtcagtctatgcagccatttgtaaacacgagggcatgccgttattgttcccgggcacggagtctgtctggaacgcgtatagcatcgctagtgatgccgacctgatcgccgaacaagaaatttgggccgcagtggatccgaacgcccaaaatgaagccttcaacattcacaatggagatgtttttaaatggaaacatctttggaaagtcttagcagaacaattcggcattgaaaagtacggactcccggagtcaggcaagaaggtgagcctaactgaactgatgaaagataagggcgctgtttgggaaaaaatcgtaaaggataatcagttactgccaaacaagctggaagaggtgggcgtgtggtggttcgcggactttgtactgggagcagaatccataatcagctgcatgaataaatcgaaagaacacggttttctaggctttcgtaacagcaaaaatagtttaatttcctgggttgacaaattgaaagctcacaaaattgtccct

SEQ ID NO: 1265 - DNA, 1170 bp, Catharanthus roseus
atgtcgtggtggtgggcgggggcggtggcggcggcgcgcaagcgatttaatgaagatgaggcgcctaaaaactttcagtcggtcgccctgatcgtcggggttaccggcatcgtaggtaactcactggcagagatcctccctttaagcgatacgccgggcggtccgtggaaggtttatggcgtggcgcgccgcccgcgtccggcgtggaatgcagaccatcctgtggagtatatccagtgcgatgtgtataatagcgacgaaacgcaggccaaaatttccccgttaactgatgttacgcacattttttggactacctgggcgaaccgtccgaccgaagcgcagtgctgcgaagtgaacggtactatgttccaaaacgtggttaacgcgttacttccgaatgcgccgaacctgagccatatttgcatccagaccggtcataaacactatatcggaccttttgaagcctttggtaaagtgaaaccgcatgacacgccgttcatcgaggacgttccgcgcttagatgcgcccaacttctactacaccctggaagatattgcctttgatgcgtgcaataaaaaagaaggcctgacctggagcgttcatcgcccggccgttatctttgggttctcgccgctttctatgatgaatttggtaggcacgctttgcgtctatgccgcgatttgcaaacatgagaacgtgccgcttacttttccggggactaaagcggcatggaactgctatagcgtcgcgagcgatgcggatttaattgcggaacatcagatttgggcagccgtggacccatatgcaaaaaatgaggccttcaattgtagtaacggggacattttcaaatggaaacacctgtggaaggttcttgcagaacagttcgaggtggattacgttgaatttgatgagaatcaagagttcgtgagcctgtcagaccgtatgaaggataaaggcagtgtgtgggatgagatcgtggaaaaaaatcagctgataccgacaaagctggaggaggtggcaacgttttggttcgccgatcttatacttgggtttgaatgcatgctggacagtatgaataagtctaaagagcacggcttcctgggtttccgcaacaccgcgaaatctttagtttcagtggtcgataaaatgaaagcccataagatcgtgcct

SEQ ID NO: 1266 - DNA, 1173 bp, Prunus mume
atgagctggtggtgggcaggtgcggtaggtgccgcgaagaaaaagttcgatgaggatgaagcgccgcgcagcccagaaagcgtaggtctggtcatcggcgtcacaggcatcgtgggcaattccctggcggaaattctgccgatttcggacaccccaggaggtccctggaaagtgtacggtgtggcgagacgtccccgcccgaattggaatgccgaccatcctgttgaatacatccaatgtgacatctcggatgcggacgacgcgaaggccaaactctcacctctgagtgacgtaacacatatcttctatgtgacgtggactaaccgttccacagaggcggaaagttgcgaggccaatggcgcaatgtttcggaatgtgctgaattcagttattcccaatgcgcccaacctccgtcatgtgtgtttgcagaccggcgccaaacattatgttggtccgtttgaagcgttcggtaaaatccagccgcatgagagcccattcacagaggatttaccacgcctcgattacccgaatttttattacaccctggaagacctgctatttgccgaggtcgaaaaaaaggatgatttaacctggagcgtacatcgtcctgatgccatctttggctttagcccttactcgatgatgaatattgtgggcaccctttgtgtgtatgcagccatttgcaaacatgaacgcgtcccattgaaatttccgggttcgaaagccgcttggaattgctattcggtagcgagtgacgccgatctgatcgcggaacagcatatttgggcggcagtggacccttacgcgaaaaatgaagcgtttaatatcaacaacggcgatgtattcaaatggaaacacgtatggaaagtcctagccgaacagttcggtattgaggagtatggtattgatgaggaagaaggagcgaagttgtccctggttgaacttatgaaagggaaggaacgtgtctgggaggagatagtgaaagagaaccaactgcagcccacgcgtctggaagaagtgggagtctggtggtttgtagatgtgtggctcggaggcgagggtctcctatgttcaatgaacaaaagtaaagagcacggcttcgtaggttttcgtaactcacgcaacagctttgtaacctggatcgataaaatgaaagcatttaaaatcgtgccc

SEQ ID NO: 1267 - DNA, 1185 bp, Ziziphus jujuba
atgtcgtggtggtgggcgggcgccgtcggagcagcgaaaaaaaaatttggcgaagatgaagccccaacctccttccagtcggttggcctggttgtaggtgtgaccggaattgtgggtaacagtctggcagaaatcttgccgttagcggacacgcctggtggtccctggaaagtgtatggcgtcgcacgtcgccctcgcccagcatggaatgccgaccacccgattgaatacatacagtgcgacatcagtgatccgcagcaaacgcaggccaaactgagcagtctcacggacgtgacccatattttctacgttacctggacgaacagaatctccgaggccgagaactgtgcggcgaatggtgccatgttccggaatgtcctgagcgccgtcatacccaatgcgccaaacctgcgtcatatctgcttgctcactgggggtaaacactatcttgcgcccttcgaatccatcggtaagatccaagcccacgatccaccattccacgaagatataccgcggttagatgctcctaatttttactatacacttgaagatatactgtttgaggagtctgaaaaaaaagaaggcggtggcttgacctggtccgtgcatcgtcctaatgtcattttcgggttctcgcccctcagcttgatgaatttgatcggttcactgtgcgtgtatgcggccatttgtaaacacttaggtttacctctaaaatttccaggcaccaagagcgcatgggacggcttctctatggtttcagatgctgatctgattgccgaacatcaaatatgggccgcggtcgacccatacgctcgcaacgaggccttcaacattaataacggcgacgtgttcaaatggaagcatctgtggaaagagctcgccgaacagtttggcattgaagattatggttttgatgacgacggagacgatggcaaacgtttaaaactcgtggagctgatgaaagacaaaggccccgtatgggaagaaattgttaaagtgaatcagttggagccgactaagttcgaagaagtgggcgtctggtggtttgcggacatgatgttaagcgaagcgggtgcactggcgagtatgaacaagagcaaggagcacggattcctcggttttcgtaacagtcgcaacagcttcgtatattggatcgataaacttaaatcctataaaatcgtcccg

SEQ ID NO: 1268 - DNA, 1185 bp, Prunus persica
atgagctggtggtgggcgggcgcggtgggcgcggcgaagaaaaagctggaaggcgcggataccacagcacctgaaggctatcagtcggtcgcgctggttatcgggctgacaggcatagtaggaaactccctggccgaaatcctgccgctccatgatactccgggcggtccgtggaaggtttatggcgtggcacgcagagcacgtcccgattggtccgtcgatcacccggttgattatattcagtgcgatattagcgatcccgaagacactcaggccaagcttagcgaacttactgatgtaacccatatcttctatgtaacctggactagccgcgctaacgaaattgaaaattgtgaagccaacggtgccatgtttcgtaacctgcttcgtgtcgtgatccctgtggccccgaatctgcgccacgtaagccttcagacgggcacgaaacattacctgggtccatttgaatgcatcggcaagattaaagcgcatgatcccccctttaccgaagacttaccgcgcctcgatgtgcctaacttctattacacactagaagacattctgttcgaagaagttcaaaaaaaagaaggcttgacgtggtcagtgcatcgcccgtataacatttttggatttagcccgcactccttaatgaatatcattggaaccctctgcgtgtatgcagcaatctgcaaaaaggaaggcaaacctctgaaatttccaggttcaaaagtggcctgggagtgctacgcgatggcatcagacgccgatttgatcgcggagcagcatatctgggcggcagtggacccgaatgccgctaacgaagcgttcaacatcaacaatggcgacgtgttcaaatggaaacagttttggaaaggcttggccgaacaattcggcatcgaagaacatggcttttacgaagaggaagaaggtgaaggtcggctcagccttgtggaaatgatgaaaggtaaagaaggcgtgtgggaggaaattgtaaaagaaaatgaactgcagcccaccaaactcgaggaagtcggtgtgtggtggtttgccgattatgtactgggcggggaagcggtgctagactcaatgaataaatcgaaagagcacggcttcttaggttttcgcaattcttataaatcctttatctcctggattgaaaagatgaaaagctataagattgtaccc

SEQ ID NO: 1269 - DNA, 1173 bp, Sesamum indicum
atgagctggtggtgggcgggcgccgtcggcgccgccaaacagaaaaaactggaagaagatgaagcgccacaaaaacatgaatcagtagcgctgattatcggcgtcaccggcctggtggggaactcattagcggaaattctgcctctgtcggatacgccaggcgggccgtggaaagtttatggtgttgcacgtcgcccgcgccccagctggtccgatgactatccgattaactacattcaatgtgatgtgctgaatcgagatgacactcaggccaaactcagcaccttaaccgacattacccacgtattttatgcgacctggaccaatcgaccgacagaagcagaaaactgtgaggcaaatggtcgcatgctgcagaacgtgttagacgccgtcattccgaactgtccgaacctgaaacacatttgcatgcagactgggcgtaaacactacgtggggccgtttgaagcctttggcaaacttgaaacacagcttgaaacgccttataccgaagatatgccgcgcctgaactacattaatttttactacaccctcgaagacattctatgtaaggaggtggaaaaaaaagaaggcttgacctggtcagtccaccggcctggcacaatcttcggcttttcgccgcatagcatgatgaatttagtaggtacgctttgcgcatacgcggcgatctgtaagcatgaaggcaaggtattacgctttccgggctgtaaagaggcgtgggatgggtattcggattgctcagacgccgacctcattgcggaacatcagatttgggcggccgtcgacccgcacgcgaaaaacgaagctttcaacgtcaacaacggggatgtctataaatggaaacatctgtggaaagtgttagctgaacaatttggagttgaatgtggcgaacatgaagaaggtcagacgatcacgttcgagggtttaatgaaggataaaggcggcgtttgggacgaaatggtgcgcgaaaacggcctgacccctaccaagctggaagacgtagggctgtggtggtttgccgatgtgattctgggtaataaatgtttcttggacacaatgaataaatcaaaagaacatggctttctgggctttcgcaatagcaagaaaagctttatcagctggatcgagaaagtgaaagcaaataaaattgtgcca

SEQ ID NO: 1270 - DNA, 1185 bp, Panicum hallii
atgtcgtggtggtgggcgggggcggtcggcgccgcctggaagcgacgcggagatcgtgccgcgagtagcgagtcattccagtttcagtctgtggcgctcgtagtgggctcgaccggcatcgtcggcactagcctcgtggatattctgccgctccccgatactcctggcggcccgtggaaagtatatgcgctgagccgccgcccacccccgccttggttccaaccaccttccccgtcagtgacacacatccaggtggacctgacagattatagcgcggctgcggaggcgcttgcaccactcaccgatataacgcacgtcttttacgttgccctaagctggcgcccgactgaagcacagagcagggaaacgaattcagcgatgctgcgtaatgttctaagcgttgtagtatcgagttgtccgagactggcacatgtctcacttcagacgggtaccaagcactatttcggtcgtctgggatcaaaaacgcgagtgcatgatccaccatacacagaagacatgccgcgtctggacattccggtgttttattatgatcaggaagatatcttatttgataccgtggcgcgtcgggccggctggtccgtccataggccgaacctgatcttcggcttttcgccgcgctctgaggccaatgttgtgtgttctctgtgcgtttacgcggcgatctgtcataaggaaggagtgaaactgagatggccgggtagtcgtgcggcctgggagggctttaacaatggatctgacgccgatctgattgctgaacaacatatttgggccgccgttgacccaatggcaaaaaacgaagcatttaactgctcgaatggcgatgtgtatcgctggaaattattatggccggtcctggcgggtcgttttggcttagaatgggcaggctacgaaggggaggaaaatcgtttccaggtggcagaagccatggcaggcaaagaagcggtttgggcggccattgttaccgaaaacgaactggttgagacggaggtgaacgaagttgcctcttggtgggttattgatgcggtggcggaccagtttgggctcgatttggaaatcctggatagcatgaataagtcgaaagagcatggcttcctcgatttccgtgacaccgtaaaatcatttaatacgtggattgatcgcctgaaggcacaaaagattgtgccc

SEQ ID NO: 1271 - DNA, 1173 bp, Fragaria vesca
atgagttggtggtgggccggcgcggtgggtgcgcacaaaaaacggctggacggagaagatgcagggccacgcacgcctgttagcgtcggtttggttatcggcgtgacagggattgtcgggaattcgctggcggaaattttgccgttgccagatacgcccggcggcccctggaaagtttatggcgtcgcccgccgtccgcgtcctaattggaatgcagatcaccctgttgattatgtgcaatgcgatgttagcaagccaaatgatgtgaaagcaaaactggcgcccctgaccgatgttacacatattttttatgtgacctggacaagcaaagcgaccgaaagcgaaaattgtgaagcgaatgcggccatgctgcgtaatgtgctgaacgcgatgataccgaatgccccaaacctgaaacatatctgtctgcaaactggtggcaaccactatctgggaccgttcgatacatggggtaaaatacagccgcacgattcccctttcaaggaggatatgccgcgtttaaacgtccagaatttctattacacgatggaagacctcatgttcaaagaagtggaaaagaaagagggtatgagctggagtgttcatcgtccagataccatcctgtggttcagcccacatagtatgattaacattctggcaagcctgtgcgtgtatgcggcgatttgcaaacacgagggcatgcctttacgcttcccgggcaccaaaggggcgtggaactgtctgtctacggcaagcgacgccgatcttattgccgaacagcagatctgggcagcggtggatccgtacgctcgtaatcaggcttttaatatcaataatggcgatgtgtttaagtggaaacatttgtggaaagttctggccgaaaattttggcatcgaggaatgcggttttcaagaaaaaggcgagcgtgtgtcgcttcgcgaaatgatgaaaggtaagtccggagtgtggaatgaaattgtaaaaaagcatcaactggtaccgacgaaactggaacaggttggcgtgtggtggttcgtagacgcgatcttctctggcgaatgtatgtttggttgtatgaataaatcgaaggaacacggattcgtgggcttccgcaacagccgtaacagtctggtgacctggattgataaaatgaaagcgtataagattgttccg

SEQ ID NO: 1272 - DNA, 1095 bp, Setaria italica
atgtcgtggtggtgggcgggagctgtaggcaccgtccgcaagcgtcaagatgatctggcggcggtgagccaatcagaacaggcatttgaaagcgttgcactggtggtgggcagcacgggtattgtcggcgcgtcactggtggatatcctgttgctgccggatacgccgggcggcccgtggaaggtcctgaccccgctgattgatattacgcatgtgttttacgtagcgtggacctggcgtgccaccgaggaggaaaactgcgaggccaattcggcgatgcttcgtaatgttcttagcgtagttgttcccaactgcccggcccttgtccatgtatcgctgcagaccggtacgcgtcactattttggccgtctggactcggaaaactgcgtgcattaccctccgtatacggaagatatgccgcggctggatatgcctgtattctattacgatcaagaggacgtcctgatcgacgcggtagcacgccgcggcggaggtgcggtgtcgtggtctgtgcatagacctaacattatttttggtttttccccgcggtgtgcgatcaacctggtatgttctctttgcgtctatgccgccgtgtgctgcaaagaaggcacgccgctacgttggcctggctcacgtggcggttgggaaggatttattaccccgtccgacgccgatctggtagcggagcatcatatctgggcgggctttgatccgatggcaaaaaacgaagcgttcaattgcagtaatggcgacgtgtgcacctggaaaaaactgtggcccatcttggcgggccgtttcggccttgaatgggtgggctacgaaggcgaagaaaaacgtctgaaactggccgaagcaatggcgggtaaagaggccctgtgggccgaaattgttgaggaaaacgagttggtcgcaacacacgtgtccgaggtggcgaactggtgggtggtagacaagagtctggaccggtacgggttggagtgggatatcctggactcgatgaataagtcgaaggagcacggattcctgggctttcgaaatactttccgtagttttaacacctgtatcgaccgtctgaaggcgcataaaattgttccg

SEQ ID NO: 1273 - DNA, 1164 bp, Populus trichocarpa
atgtcgtggtggtgggcaggagacctgtcagcagcttggaaaaaaccggcggtccagggtggtcaggggagtgtagccttaattgttggcgttacgggtatcgtgggtaattcgctggccgagattttgcctcggtccgatacgccgggtggtccgtggaaagtctatggcgtcgcccgccgtccgcgccctaattggcatgaaaactgtccggtcgagtacattcagtgtgatattagtgatagtgcccttgcgaaaagtaaattatctcatttaaccgacgttacgcatattttttacgtgacttgggcatctcgctccaatgaagcagagaattgtaaaattaacggcttaatgttccgtaatctgctgcaagcggtagtccccatcgcgactaatctgcgccatgtaagcttgcaaaccgggaccaaacactacattggcccgtttgaaagcttttataatttcgagagccatgatccgccttatagtgaagacctgccgcgcctgaaggtggacaatttttactacaccctcgaagacgtgatgtttgaggaagttgcaaaaaaagagggagtcacgtggtcggtgcatcgtcctgacatcatcttcgggttcagtccgcattctttaatgaacattattgtaaccctgtccgtgtacgcggcaatttgcaagcacgaaggtgcgccattaatgtttccgggcactaaagaagcatggaactgctatgcgattgcgtcagacgccgatctggttgcggagcaggaaatctgggcgtgcgtggagcccaacgcgcagaatcaagccttcaacatccataatgcagactacttcaaatggaagcatttgtggaaagttttagctgaacagtttggtattgagaaatatggctttgaagagggggggaaacgcgctactttggctgagcgaatgaaagataaaggtccggtatgggaagagatcgttaaaaaaaaccagctgtttccgacgaaactggaggaagtggggggttggtggtacgtggataccatgctcagtggcgacgcgtttatcagttgtatgaacaagtcaaaagaacacggcttcctaggcttccgcaatagcacaaaaagcttcgtccattggatcggaaaaatgcgctcgcagaaagtaattccgaat

SEQ ID NO: 1274 - DNA, 1170 bp, Juglans regia
atgagttggtggtgggcgcgcgcaataggcgcggcgaagaagaaattagaagaagacgaacaaccacgcagctttcaaagcgttggcttagttattggcgtcaccggcatagtgggtaactcgctggcggaaatcttgcctttatgcgataccccgggcggtccgtggaaagtatacggcgtggcgcgtcgcccccgccctgattggaatgccgatcatccgatcgagtatatccaatgcgacgtaagcgatccggaagacactcaagcgaagctgagcccgttaacggatgttactcatattttttacgtcacttggaccacccgcccaactgaagcggagaactgcgaagcaaacaaagccatgtttagaaacgttctgctgactgttattccaaatgccccgtcgctgcgtcacgtctgcctgcagaccggcaccaaacaatacctgggcccctttgaatcctttcgcaaattccagactcacgatccccctttcacagaggaccttccacgtttggatgcgccgaatttctactataccctcgaagatgtgctgtttgaagaggcggataagaaggaaggtttaacttggtctgtgcatcgccccaattcgatctttgggttctccccctatagtctggccaacattattgggatgttttgtgtttatgcagctatttgcaagcatgaacgtgtgccgcttaaattcccgggtaccaaggcagcgtgggatggttactgggtaagcagcgatgctgacctcattgctgagcaacagatttgggcgtcagtggatccgaatgcgcgcaacgaagcctttaactgcaacaacggtgatgtgtttcgttggaaacacttgtggaaagtcttagcggaacagtttggaattgacgattacggcttagatgagggcgaaaaagttgtcagtttggtggagatgatgaaggataaggacgcggtttgggaggaaatcattcgtgaaaaccagctgcgcccacgcaaactggaggaagttggtatgtgggttctggtggacctgttatttggaggagaaagcccggtggactgcatgaacaaatcaaaagagcacggttttctgggtttccgcaatagcaaaaatagctttattagctggattgataagttaaaatcgtacaagattgtgccg

SEQ ID NO: 1275 - DNA, 1170 bp, Jatropha curcas
atgtcttggtggtgggcgcgtgccatcggcacggccagcaagaaaatcgaggaggatgaccgtccaccaaaatttaaatcggtcgccctgataattggcgtgaccggcatcgtggggaactcactggcggaaattttgccgctcgccgataccccaggcggaccgtggaaagtgtatggcgtcgcccgccggccgcaaccgatctggcaggcaggtcatctcaccgagcacattcaatgcgatatctcaaacgaagaagagacatttgagaaactgtcccacctgaaagacgtaacgcatattttttatgtcacgtgggcctcgaaaccaaccgaagccgaaaattgcaaaattaatggctctatgctgcaaaatgtcctcaagacggtcattccgaacgcgaaaaacctgcagcatatctgcttgcaaactggccagaagcactatttgggctcgttcgaaagcatcggcaaaattgtcccgcacgaatcaccgttccacgaagatctgccgaggttaaaagctatcaacttctactatactttagaagacgttctttttgatgaagtgtctaagcgcgaaggtctcacttggagtattcaccgccccgcggcgattttcggcgtttccccgtgttcattaatgaatgtcgtcggtacgttttgtgtgtatgcaactatttgcaaacataagggactgcctctgacctttccagggaatcagctcgcatgggatggctattggtacgccagcgacgcagacctgattgcggaacaccagatttgggcagccgtggatccgaatgcgaaaaatgaagctttcaattgctcaaatggcgacgtgtttaaatggaaacacctctggaaggttctcgccgagaaatttgaaattgataactatggatttgaagcgggtgataaaaaactgtccttagtggaacgcatgaaagatatgggccctgtatgggatgaaatagtgcgtgaaaaagagcttgttccgacaaggctggaagaagttggggcgtggtggctcatcgatttatttttccagggtgcagcatacttagatacaatgaacaagagcaaagagcacggattcgtggggtttcgcaactccaagacctgcttcgccagttggattgataaaatgaaaagccaccgtattgtgccg

SEQ ID NO: 1276 - DNA, 1176 bp, Hevea brasiliensis
atgtcctggtggtgggcacgcgcagtagaagccacgaaaaaaacctttgaacaagacgatgtgccaccaaagtaccagagcgtggcgctgattattggagtgacgggcattgtaggtagtagcctggccgaaattctcccatttgcggatactccgggaggcccatggaaagtctatggtgtggcacgccgacctcgcccgatttggcaggcgaaccatctgattgaacatatccagtgtgacatcagcaacgaacaagaaacccatgaaaaactcagcattttgacggacgtgactcacattttctacgtgacgtgggcgcgtaaaagcaccgaagcggaaaattgtcttgtaaacggcagcatgttgcagaacgtcctgaatgccgtgattctaaacgcgcgtaatctgcaacacatttgcctgctgaccggtcgtaaacattacatgggttcgtttgaatccatcggcaacattgcgccgaatgaatatcccctacacgaagatttgccgcgcttgaacgttattaacttctactatacgctggaggatttgttattcgaccaggttcgaaaaaaagaaggactgacatggtctattcaccgcccgggaatgatatttggtttcagcccgtttagccttatgaacaccctggggaccctgtgcgtgtatgcggcaatttgcaagcatcagggcctgccgttgattttcccaggtaatcatgtggcgtgggacggctactgtgacgcgtcggatgcggatctgatcgcggagcatcagatctgggctgcagttgatccgaacgcgaagaatgaggcctttaactgttcgaacggcgatgtgtttaagtggaaacacttgtggaacgtactggcagagcagtttgagattgagaactacggcatcgaagaggacggcgataaacgcctgagccttgctgaaatgatgaaagatatgggtccgatttgggatgagattgtcaaagagaagcagctcttcccgacccgcttagaagaagtggcaacgtggtggctactggacgttgtttttcaactggaagtttcacacttggatacaatgaacaaatcgaaagaacacggttttgtcggcttccgcaatagcaaaaaaagcttggtgcactggattgacaaaattaaagcgtataaaatcgtccct

SEQ ID NO: 1277 - DNA, 1167 bp, Camptotheca acuminata
atgtcttggtggtgggcgcgctcgctgggcgctcagaaggaatttaaagaaaatggagcgctgacgagctaccagtcggtaggattgattatcggtgtgaccggtatcgtcgggaattcactcgccgaaattctgccgttaccagatacgcccggtggaccgtggaaagtctatggcgtggctcgtcggccgcgccctgcatggaatacagatcacccgatcgagtacatccaatgcgatgtggcctccaccgaagatactctggcgaaattgagcccgttgaccaatattacgcatattttctatgttgcatggacgggtagtgaagattgcgaggtcaacgaaaccatgttccataacgttcttaaagcagtaatcccgaacgcgccgaatcttcggcatatctgcattcaaaccggcattaaacattatactggaccgcttgatccggatggcggcatccaaccgcatgacagcccctttactgaagatctcccgcgtctgaacgcgcctaacttttatcataatttggaagatatcttaatcgaagaagccgcaaaaaagaaaggtttaacgtggagcgttcatcgtccggccctggtatttggcttcagcccgtactccatgatgaacattattggtgcacttagtgtgtatgcggtgatttgcaagcatgagaataaaccactgatttaccatggggcccctgacaattcacgagactcttggaacgtttatgctgacgctgccgatgcggatttaatcgcagagcatcagatttgggctgctgtggattcgaacgcgaaaaatgaggtctttaactgttcgaacggtgatgtgtttaaatggaagcagatgtggaaaattttggcggaacagttcgaggtcgaactggtcgggtatgaagatggccagaaacgcatgagtctgcaggaacgcatgaagggcaaaggcccggtgtgggacgagatagtgcgcaaacacaaactgctgccgacgaaattagaagatgtggcgcagtggtggttcgcagatatcgtgagccagagccagaacctggtcaacggtgttaataaaagtaaagagaatggattcctcggctttcgtgattcaaaaaaatccttcgtttattggataaaaaaaatgcgcgcggcgaaaattatcccg

SEQ ID NO: 1278 - DNA, 1176 bp, Malus domestica
atgagctggtggtgggcgtcggccgtagaggcggcgaagaaaaagcatcaggaagaccgctacgaaccgccgagcatcccgaaatcagtaggcctggtaattggtatcacgggcatagtcggcaactctctcgccgaaattctgcctttatcagacacccccggcggtccgtggaaagtttacggagtggcccgacggccccgcccgcattggaacgcggatcatgccgtcgactacattcaatgtgatatttccgatccagatgacacccaaaaaaaactgagcaaactgtctgacgtcacccatattttttatgtgacctggacaaatcgaagcactgaaaacgaaaactgtgaagccaacgcagcgatgcttcgcaatgttctgcgtattgtgattagcaatgcaccgaatctgcgtcatgtgtgcctacagacgggaaccaaacaatacattggcccgtttgagactttcggtaaaatcgatcatcatgatccgccgtgcagcgaagaccttccgcgcctgaatgcaccgaacttctactacgcgcttgaagacgttttactggaagaggtaggaaaaaaagaagacattacgtggtctgtgcatcgcccgggtgtgattttcggattctcgccatacagtctcgcaaacatggttgccatgctgagcgtatatgctgccatctgcaaacacgagggtatgccgttgaaattcccgggtagtaaagaagcctggaactgctactcggacgcgagcgatgcggatctgatcgcggaacagcagatttgggccgccgttgatccgtacgccaaaaataaagcgtttaacgtgaataatggcgatgtctttaagtggaaacagctgtggaaagtgcttgctgaacagtttgaaatcgaggaatatggcttcgacgaagaaggcgaaaaactgagcctggccgaactgatgaaagttaaagaaggtgtttgggaacagatcgtgaaagaaaaccagctggaacccatgaaactagttgaaattggtcagtggtggctggtagatctggtgttcggcggggaagggttgatgacaagcatgaataaaagcaaagaacacggttttctcggttttcgcaattcaggcaactcatttgtgagctggatcgataagttgaaagcgtttaaaatcgtgccg

SEQ ID NO: 1279 - DNA, 1128 bp, Panicum hallii
atgtcatggtggtgggaacgcgccgttggtgaagtgagtaaacgccgcggagatcgcgcggctgctagccaccgcagtttccaggtgcaatcggttgcattggttgtaggcagcaccggcgttgttggcgcgagcctggtagatattttaccgcagcctgataccccggggggtccgtggaaagtttacgctcttagcccgagaccgcctccgccttggtatccgtcccgttcaccgagttcagtcacccatgtgcacgttgatctgacggattctccggctgttgccgaagcacatgcgccgctgacggacataacgcatgtgttttacgtagcctggagcagccgaccaacggatgctcagaaccgtgaggcgaatgctgcgatgcttcgcaatgttctgtccgccgtagttcctacctgcccggcgttagcccacgtgtgcctgcaaacaggtacgaagcactacgttggttcgttcgaagccattggccgagtcccgcttccggaaccgccatatacagaagacatgccacgcctggactgtcccgatttctattatgaccaagaagacattctggtggatgcggttagtcggcgcggcggcgtgagttggtcggtccaccggccgcgactgatcttaggcttcgccccgcgcagtgccatgaatgttgtctgtagcctctgcgtgtacgccgccatatgccgatcggaagacgtccgggcagttgtgcgctggccggggacgcgtggcgcctgggagggttttgataacgcaagcgatgcagatctggtatccgagcagcagatttgggccgctgttgatccgatggcaaaaaatgaggcctttaactgtagcaacggtacagccggtatggaagatgttcgtgcagtgatcgcgaaagaaaatgaacttgtcgaaacgcagctgaatgaagtggcgtcttggtggctggttgaagcgcagttttgccagttcggcgccaaccgcgccttcctggattcgataaacaaaagcaaggaacatggctttctgggctttcgcaataccgtgaaaagctttaacacctggattgacgaaatgaaactacataagatagttccgcgctgtctctttatgatgttcatt

SEQ ID NO: 1280 - DNA, 1173 bp, Arachis duranensis
atgagttggtggtgggaacgttctacaggtgcggctgccaaaaacatatctaatgaaattgacgagagcagccaaaatttacaaaatgttgctctgatcattggagttactgggattgtgggtaatagcctcgctgaaattttaagcttacagaacacgcctggtggtccgtggaaagtatatggcgtagcccgacgtaatcggcccgcgtggaatacaaaccacccggttcattacgtgcagtgtgatatttcaaacccaaacgatgtggcactcaaactgagtccgcttacggacgtaacccatattttttacgtgagctggaccagcaagagtacggaagcgcaaaatattgaagttaatggcagtatgtttcgtaatgtgttaaacgcactgatttcgaacgccccaaacttgcgccatgtttcactccagaccggcgtgaaacactatgtgggcccgttcgaactgtttggaaagatcaaagcaaatgagccgccatttaccgaagacctgccgcgtgttaatgcaccgaatttttactatacgcaagaagacattctgttcgaaatggcgcagaaaaaggaaggtttgacctggttcattaaccgcccgcaagttatatttggctttagcccgtactccctgatgaacctgattggcacgttatgtgtctacgccgccatttgcaaacatgaaggcgtgctgctgagatttccgggcaccaaggccgcatgggaatgttacagcgcggccagtgacgcaaacctgatcgccgaccagcacgtgtggggcgcggtcgatgcgcgggcccgtaacgaagcctttaatgtctcaaacggtgacgttttccgctggaaacatctctggaaagttctggccgagaaattcggtatcgaagaatatggattcgtagaaggcagctcattacgcctctctgacttaatgaaagacaaagggggcgtatgggatgagatcgtgaagaaaaacaatttgcaagccacgaaattggaagatgtaggcgattggtggtttgctgatatcatcctgggcatggaagcggtgctggataacatgaacaaggccaaggagcatggcttcctgggttttcgtgactccaaaaaatcatttattaactggatcgaacgcacgaaagcctacaaaattgtaccc

SEQ ID NO: 1281 - DNA, 1164 bp, Catharanthus roseus
atgtcctggtggtggaaacgttcaatcggagcgggcaaaaaccttccgaaccagaataaggaaaatggagtttgcaaaagctataagtccgttgcacttgtggtgggcgtgactggaatcgtgggcagtagtcttgcggaagttcttaaactgccagacacaccgggcggcccatggaaagtgtacggcgtggcgcgccgcccgtgccccgtgtggctggccaaaaagcccgtagaatacatacaatgtgacgtgagtgataatcaggaaaccatcagcaagctgagcccgttaaaagatattacccacatattctacgtgagctggattggctcagaagattgtcagaccaacgcgaccatgtttaagaacattcttaacagcgtcattccgaacgccagcaacttacagcacgtgtgtctgcagaccggcattaaacattattttggcatttttgaagaaggaagcaaagtcgtgccgcatgatagtccgtttaccgaggatctgccgcgtctaaatgtgcccaatttttaccatgatctggaggacatcttatatgaagaaacaggtaaaaataacttgacgtggtcggtgcatcgtccggccctggtgtttggtttctcgccgtgctctatgatgaacattgtctccacattatgcgtgtacgctaccatctgtaaacatgagaacaaagccttagtctaccctggcagcaaaaattcgtggaactgctatgctgatgcagtggatgccgatctggtagcggaacatgaaatctgggcggccgtagacccgaaagccaaaaatcaggttctgaattgcaacaatggtgacgtgttcaagtggaaacacatctggaaaaaattggcggaagaatttggaattgagatggtcgggtacgtggaaggcaaagaacaagtatccctggcagagctgatgaaagataaagaccaggtgtgggatgaaattgtaaagaaaaataatctggtccctacaaaactgaaggagattgccgctttctggttcgcggatatcgccttttgcagtgagaacttaatctcaagtatgaacaagtccaaagaacttggtttcttagggttccgtaatagcatgaagagtttcgtatcgtgtattgataaaatgcgtgactatcgctttattccg

SEQ ID NO: 1282 - DNA, 1185 bp, Spinacia oleracea
atgtcatggtggtggctcggtgccattggctcaagcctacacaaaatcgaatcaggtgatattccgagcaagtatcacaacgtggcgttggtggtcggcgtgaccgggatttcgggtaacagccttgcagatattctgcaacttagcaccatcccgggaggccgctggaaagtttacggtgtcggccgccgccgccagccggagtggcagttccatcacaatcatgttcagtacattcagtgcaatatggtggacccggaggattgtcaggccaaacttagccatctgagcgatgtgacccacattttttacgtagggtgggtcaccaaacccaccgaacaggaatccagtgacgaaaacggcaaaatgctgcgcaacgtgctcaacgcagtgatcccgaatgcccccaatttgaaacacatttgcttacagaccggtcaaaaatatgccttaccgtgcctagatagttcagccgaaattcagcacgagccgcagtttgtggaggaatttccacgcgaagatatcacggatagctattacgctatggaagacatcctggatgaagaggtacagaagaaagaaaaattaacttggagcgtccaccgtcctgctgtgatgtttggcttttcaccgtatagcacccgtaacatcgtgggaagcctctgtgtgtacgccactatctgtaaacacgaagggcagccgttacgctttcctgggaaccaggcggcgtgggatggttactctgaagcgggggatgcggatttggttgcagaacagcagatctgggcgagtctggacaataagggaaaaaaacaagcttttaattgttcaaatggtgatctgtttaagtggaaagacctgtggaaagttttagcggaagagtttgaggtgaaatttctggagttcgaggaggagtcaaactcactggaagaaatgatgcgtgaaaagggccctgtgtgggatgaaattgtacaggaaaaagatctgctgcccacaaaattagaagaagtcggcacatggtggtatgtcgacagtatcctgaggagcagtgaagccgtgctcgatagtaacaacattagccgcggcatggaaaaatcccgcaactacggtttcggcggctcacgtgaaacggcggaaagctttcgcttctggatagaacacacacgtcgatacaagattattccg

SEQ ID NO: 1283 - DNA, 834 bp, Trifolium subterraneum
atgagctggtggtggtccggtgccattggcgcggcgaaaaaaaagttcgatgaagatgaagctcctcgctcattccagagcgtagggttagttatcggtgtgacgggtattgtgggcaacagcctagcagagatattgccgttaccggacaccccggggggccggtggaaggtgtatggggtggcccgccgtcctcgcccatcctggaatgcggatcatcctatcgaatatattcagtgcgatattaccgatccgaatgacacccaaacaaaattaagcgtgttaacggatgtaactcacattttctacgtgagctggaccaatcgtcctaccgaagccgaaaactgcgaggtaaatggtgccatgttgcgtaacgtcttacgtgcggttattcccaacgctcccaacctgcgccatgtcagcctacagactggtggcaagcattatttgggcccatttgatctaataggaaaaattaaaagtcatgagccgccgtttaccgaagacctgccgcgcttggatgcaccaaatttttactatacccaggaggacattctcttcgaagaaacgaaaaaaaaagaaggtctgagttggtccgtccatcggccgcaggtaattttcggattctcaccatattcacttatgaacatcgtaggaacgctgtgcgtatacgctacaatctgcaaacacgagggcgtgccgttacgtttcccgggtgaaggtaccgtggatatcatgaataaagccaaggaacacggtttcgtaggttttcgtaacacgaaaaactcgctgatttattggattgataaaaccaaaggatataagatcgtactg

SEQ ID NO: 1284 - DNA, 1170 bp, Ziziphus jujuba
atgtcttggtggtggtctggagctattggggccgcaaaaaaaaaatttgacgaaattgagacccccatctcataccaaagcgtcggcctggtcatcggcgtgaccggcatcgtaggaaactcattagcagaaattctgccgttatcggatacgccgggcggcccttggaaggtgtacggcgtagcccgtcgtccgcgccctgactggaacgcagatcaccctgtcgagtacattcaatgtgatatcgccgacgcagatgatattaataaaaaactgagtgatttgaccgacgttacccatttattctacgtgacgtgggcgaaccgtagcactgaagaggaaaactgcgaggttaacggtacaatgttccgtaatgtgctgcgtgccgttattccaaacgcccccaagctccgtcatatctgtctgcagacgggtactaaacactataccggaccgtttgaatcccgcggcaagcaggagcatcacgatccgcccctcacagaagacttgccccgactgagtggaccgaacttttactacacactagaggacgttctgtatgaggagactgaggacaaaccgaaccttacctggagcgttcaccgtccgaacacgatctttggcttctcacccttcagcttaatgaacatcattggaacattgtgcgtatatgccgccgtgtgcaagcacgagggcgtgccgcttaaatttccgggtaaaaaagccgcttgggatagctactcagtggcgagcgatgccgatcttgtggcggagcagcagatttgggcagccgttgacccgtatgcgcggaacgaggcctttaactgcaacaacggagatgtattcaaatggaaacacctctggaaggtgttagccgaacagttcggtattgaaaactatggcatcgaagagggcgattcgcttagcttggtggattgggcaaaaggcaaagagaacgtttgggaggaaatcgtccgtgaaaaccagctgcaacccaccaaattagaagaactcggcgtttggtggtttgcggacctgattttgggcgaggaagctctactggacagcatgaataagagcaaggagcatggctttatgggctttcgcaattcgcgtaactctttcattagctgggtggataaatttaaagcctacaaaattgttccaaac

SEQ ID NO: 1285 - DNA, 1167 bp, Medicago truncatula
atgtcttggtggtggagcggcgctattggcgcggccaagaaaaaactggatgaagatgaagccccgcaatcttttcagaacgtagcactggtggtgggagtaactggaattgtaggaaactctctagcggagatattaccgcttgccgacaccccgggcggccgctggaaagtatatggcgtcgctcgccgtccgcgcccgagctggaacgccgaccatcccatcgaatatattcagcgcgatattactaactcgaacgatacacaaactaaattctccatcctgacagatgtgacccatatcttctacgtgagctggacctcacgtccgacggaagaggacaactgcgaagtgaatggggttatgctgttaaatgtactgcgtgccgttattccgaacgccccgaacttgtgtcacgtaagcctgcagacgggcggcaaacattatctaggtccgttcgcgctgattgataaaattaacagtcacgaaccatcttttactgaagatttaccgcgtctggatattccgaacttctactatactcaagaagatatcctgtttgaagaaaccaagaagaaagaaggtttaagttggtcagtgcatcggcccttgcttattttcggcttttcgccgtatagtctgatgaatgtggtcggcacgctgtgcctgtacgcggcgatttgtaaacatgaacacatttcgctgaaattcccgggaacgaaacgcgcttgggaatcatattatatggcgagcgatgccgatctcattgccgaacagcatatctgggctgctgtggacacctacgcaaaaaacgaagccttcaattgctccaatggagacgtgttccgttggaaacagttgtggaaagtattgacggaacagttcgagattgaagagtacgggtatgaagatggtccacgcctccgcctggccgaaatgatgaaagacaaaggcccggtatgggacgaaattgttaaagaaaatgagttacaaccgaccaaactggaggaggtagccgaatggtgggtggcagatgccacctttggtatggaggatatagttgattccatgaacaaagccaaggagcacggctttctaggttttaggaatagtaaaaactcgctgataaactggattgacaaaacccgtgcctataagattgtgccg

SEQ ID NO: 1286 - DNA, 1170 bp, Medicago truncatula
atgtcgtggtggtggagcggcgcaattggagctgcaaaaaaaaaactggatgaagatgaagcgccacgtagttttcagaatgtcgcgctggtggtgggtgttactggcatagtgggtaatagtttggcggagattctgccgctcgctgatacgccgggcggtcgctggaaggtgtatggcgtagcccgccgaccccgcccgtcctggaacgccgatcacccggttgaatacatccagtgcgatatcacggatccgaatgacgcaaccactaaactgtcagtgctgaccgatgtcacacatgttttctatgtttgctgggccagccgtcccacagaagcggaaaactgcgagatcaatggtacaatgttaaaaaatgcgctcactgcggttattcctaatgcacctaacctgcgccacgtcagtattcagaccggaggcaaacactatgtggggccgtttgagagcttcggcaaaatcaaataccatgaaccgccgtacacagaagatatgccgcgcctggattatcataatttctattataccttggaagacgttttgttcgaggaaaccggcaaaaaagaaggggttagctggagtgtgcatcgcccgctgctgatctttgggttctcgccttatagtatgatgaacattatcggcaccatttgtgtatacgccgccatatgcaaacacgagggtgttccgctgcggtttccgggaacgaaattagcttgggaaaattactacatggcctccgacgccgatctgattgctgaacagcatatttgggccgccgtggacccctatgcgaaaaatgaagcttttaattgctccaacggcgacgtttttcgctggaaacagctgtggaaagtcattgcagagcagttcggcattgaggagtatggtttcgatgaagaaggcccgcgtttaaaattgactgaactgatgaaggataaagggccggtgtgggatgaaatcgtgaaagagaacggattacaggtgaccaagctggaagaagttgcggaatggtggtttgccgatgcgtgcttcggaggcaatggttttactgattcaatgaacaaaagcaaagagcacggattcctgggctttcgcaatactaaaaactccctcattaattggatagaccgcacccgggcctataaaatcgtacct

SEQ ID NO: 1287 - DNA, 1170 bp, Medicago truncatula
atgtcctggtggtggagcggcgccattggcgccgcgaaaaaaaaacttgacgaagacgaagcaccgcgaagctttcagaacgttgcgctcgtcgtgggcgtcaccggcattgttgggaatagccttgccgaaattctcccacttgcggatacgcctggtggccgttggaaagtatacggcgttgcccgtcgctcgcgccccagttggaatgcggaccatcctgtggagtacattcagtgtgatattaccgatccgaatgatgcaacgactaaattatccgttctgacagacgttacccacgttttttacgtgtgttgggcgagccgccctactgaagccgaaaactgtgagattaacggggctatgctgaaaaacgtgctgacggcggttatcccgaatgccccgaacctgcgccatgtctcgatccagaccggtggtaagcattatgtagggccctttgagtcgtttggcaaaattaaataccacgaaccgccgtacaccgaagatatgccgcgcctggattatcacaatttttactacacactggaggacgtgctttttgaagagaccggcaaaaaagagggtgtgagctggagtgtccaccgccctcttctgatttttggtttcagcccgtatagcatgatgaacatcattgggacaatctgcgtttacgcagccatctgcaaacatgagggagtgccgttacgctttcctgggacgaaactggcctgggaaaattattatatggccagcgacgcggatctaattgccgaacagcatatctgggccgcagtggatccttatgcaaagaacgaagcgtttaattgcagtaacggtgatgtgtttcgttggaaacagctgtggaaagtgatcgcggaacaatttggcattgaagaatacggttttgatgaagaaggcccgcgtttgaagctgacggagctgatgaaagacaaaggcccggtctgggatgagatcgtcaaagaaaacggactgcaggttaccaaactggaagaggttgccgagtggtggttcgcggacgcgtgttttggcggtaatggttttaccgacagcatgaacaaaagtaaagagcacggttttctgggttttcgcaatacgaaaaacagcctgattaactggattgatcgtacgcgtgcgtataaaattgttccg

SEQ ID NO: 1288 - DNA, 1194 bp, Spinacia oleracea
atgagttggtggtggtcgggtgcaattggcgcggcgaaaaaaaaactcgaagactcggatgaagggagctcgtcgtcctctcgtaattaccagtcggtagccctgattgtgggtgtgacgggcattgtgggcaattccctggctgaaattcttccgctttcagatacgccgggtggtccgtggaagatttacggtgttgcgcgtcgtccgcggccggattggaattcagaccatccaattgaatacatccaatgtgacatcagtgacgagaacgacgcggtgtcgaaattgtcacctctcactgatattaccaacatcttctacgtgtgttggggcaaccgcgattctgaagccgaaaatcgtgaattaaactccaaaatgtttcgcaatgtgctgaattctactatcccgaacagcccgaacctaaaacacatttgcctgcagactggcatgaaacactacattgggccctttgaatcttggggtaagaaaattgaccatcagcaccacgatccgccattcaatgaagatatgccgcgtctggacattccgaacttctactacgacctggaggacattctgtttgccgaaattgccaaaaaagagagcctgacctggtccgtgcaccgtcccggcagcatctttggctttagcccatatagccttatgaacgttgtaggtagcttatgcgtttatgccgctatttgcaaacatgagggtgtacctctgcagttccctgggaccaaggccagctgggaatcttatagccaggcgtcggatgccgatctgattgcagaacatcaaatttggaccagcgtagatccctacgccaaaaatgaagcattcaactgtagcaatggagatgtttttaaatggaaacaactgtggcgtgtcttgggcgagcagtttgaagtggaaatcgctgacttcgatgaagacggtgaacgcttttcaattgaagaacgcatgaaaggcaaagaaggagtgtgggaagaaattatccgagagaatggcttagttgcgaccaaactagaagaagtcggcagctggtggtttttagacaaagcgtttgacggcgagtggcatctcgacacgatgaacaaaagcaaagaacacgggtttttgggttttcgcaacactaaaaactcgtttgtgagctggatagacaaaatgaaagcatataagattgtgccg

SEQ ID NO: 1289 - DNA, 1167 bp, Juglans regia
atgtcatggtggtggtccggcgccattggcgcggctaaaaaaaaaagcgataaccgtgattcaccgccccgctaccagagtgtggccctgattatcggtgtgaccggtatcatcggcaattcattggccgaaatcctcccacacagcgatacccccggtggcccgtggaaagtctacggcgtcgcccgtcgcccccgcccggcttggtcagccgactacccgattgaatatattcagtgtgatattcttgatgcgcaagaagctcagactaaactgtcgaagttgaccgatgttacacacattttttacgtggcgtgggccaacatgcaagatgaagcagataattgcaaagtaaacgcggatatgctccgtaacgtgctgaatacaattattcctaaagcgcctaatctacaacatatctgccttcagacgggccgtaaacattacgtggtggcaccggaactatttgagattgtgaaaccgcacgaacctccgttccatgaagacctaccgcgcctgaacgtcccgcatttctactactcgctcgaagatgtgctgttcgagcaagtagccaaagaagaactgctgacgtggagcgtgcatcgccctggcgtcattttcggcttttcgccccgcagcctgacgaacattgtgggcagtttgtgcgtttatgcggcgatttgcaagcatgaaggtgaacagctgaggttcccaggcagcctggcagcatgggaaggctattgggatgcgtcagatgcagatatggtcgccgaacaccaaatttgggcagcggtggatagcaacgcaaaaaacgaaagctttaattgcagtaatggcgacttgtttaaatggaaacacttttggaaggtgttggccgaacgcttcggggtggagtgcggtaagtttgatgagaattcgaacctgagcctccaggaaatgatgaaaaataaaggacccgtatgggaagagatagttcgcgagaagggcctcatgccgaccaaattggaacaggtgggtacatggtggttcgttgatgaagttctgggtgcagaaagcttcttggactctatgaacaagtcgaaagagtacggatttgttggctttcgtaacagcaaaaccagcttcaactattggattgataaaatgcgcgcccatcgcattgtcccc

SEQ ID NO: 1290 - DNA, 1173 bp, Populus tremuloides
atgtcttggtggtggtccggggccattggcgcagcgaaaaagaagaccgaagatgatgaagcgagccgcggttatcctagtgtcgctctgatcttaggagttacgggtattgtgggtaattcactggctgagatcttacccctgtctgatactccgggcggcccgtggaaagtatatggcgttgcgcgccggccgcgcccgaattggaatgaggatcacccggtggaatacattcagtgcgacattagcaatactgcggagacgcaaagcaaattgagcaaattgacagatgttactcacgtcttctacgtcacctgggcgtcgaagtcgaccgaagaagaaaactgtgagattaacggactcatgtttcgtaacgttctgcaggccgtgattccgaacgccgctaatctgcgtcacgtatgcctgcaaaccgggggcaaacagtatgtgggcccgtttgcactgctgggcaagatcgaagcgcatgacccacccttcaccgaagacttaccgcgcctgaacgacttcccgaacttttactatacgctagaagatgtaatgtatgaagaggttgcgaaaaaagaaggcgttacgtggagcgtgcatcgcccggacattatctttgggttttcaccccatagcctgatgaatctgatcgtaacgatatcggtttatgcggcaatttgcaagcatgaaggtgcacccttgatctttccgggaaccaaggaagcatggaacggttacgcgatcgcaagtgacgcgaacctgatcgccgagcatgaaatctgggcctgtgtggaacctaaggccaagaatgaagcgtttaacattaacaacggtgatttattcaaatggaaacacatgtggaccgtgctggcacaagaattcggtatcgagaagtacggcttcgtggaaggcgaatctagcgttacctttgccgaaaaaatgaaggacaagggcccggtgtgggaggagatcgtgaagaaaaatcagttattaagtaacaaattagaacaggtgggcggttggtggtttggtgatttgatttttagcggcagtggctatgtagcctccatgaacaaagccaaagaacacggctttctgggatttcgcaattctaagaaatcattcgtcagttggattcataaaatgagggcgtacaaagttgttccg

SEQ ID NO: 1291 - DNA, 1023 bp, Vitis vinifera
atgtcctggtggtggtcgggtgcgattggcgcggcaaagcgcaaactccaggaagatgaagcccatccaaccaactatcagggtgtgggcctgatcgtaggcgttacagggattgtgggcaacagtctggcagaaattttaccgttacgcgataccccgggcgggccctggaaagtctatggggttgcccgccgcccgcaaccggcgtggaatgcggataactgtgtggaatatatccagtgcgacgtgtttgatccggaagagaccagctcgaaattaagcaagctgaccgatgtgacccacatcttctatgtgacctgggccaacatgggctcagaagcagaaaattgtcgtcacatctgtctccaaaccggtcgtaaacattatatcggcccgtttgaagcccttggaaaaattgaaccccatgacccgccgtatcacgaggaaatgccgcgcctcgacgtggaaaacttctatcacgtgcaggaggatattttatttgaagaagttcgaaagaaagaaggactgacgtggtcagtacaccggcctggtgtgatcttcggcttctctccatatagcatgatgaacgccattgggacgttgtgcgtgtatgccaccatctgtaaacatgagggtttaccgttgcgattccctggtacccaagacacgtggaacggctactgggacgtgtctgatgccgacctcatcgccgaacaccatatttgggcagcagtagacccatttgcgaaaaacgaagcctttaattgttccaacggcgacgtatttaaatggaaacatctgtggaaagtactggctgaacaattcggcctggaagagaagggcctagtgccgactaaattagaagaagtaggtcagtggtggtttgcggatgtggttttgtcggcgggtagtagcctggatagcatgaataaaagtaaagaacatggatttctggggtttcgtaattctaagtcctcgttcctgtcgtggatcgacaaaatgaaagcatacaagtttgtgcct

SEQ ID NO: 1292 - DNA, 1167 bp, Vitis vinifera
atgagctggtggtggagcggagcaattggggcagcgaaacgcaaactacaagaggatgaggcacacccgacaaattatcagggtgtgggtctgattgttggcgtgactggtatcgtaggtaacagcctggcggaaattcttccgttgagggatacgccgggtggcccgtggaaagtttatggtgtggcgcgtcgtccgcagccagcctggaacgcggacaattgcgttgaatatatccagtgtgatgtattcgatccggaagagaccagctctaaactgagcaagctgaccgatgttacccacatcttttacgtgacctgggcaaatatgggttcggaagcggaaaactgcagggtaaacggcgatatgtttcgtaatgttctctcagccgttattccgaatgctccgaacttacaacatatatgcctacaaaccggaagaaagcactatatcggcccgtttgaggctctagggaaaatcgaaccgcatgatcctccctaccacgaagaaatgccccgcttggatgtggaaaatttctaccacgtgcaggaggatattctgttcgaagaagtacgcaagaaagaagggctgacctggtctgtgcatcgtccgggcgtgatttttggtttttcgccgtatagcatgatgaatgcaatcggcacgctttgcgtgtacgcaacgatctgtaaacacgagggactgcccttgcgcttcccgggcactcaagatacttggaatggctattgggatgtgagcgacgcggatctgattgccgaacatcacatatgggcagcggtagacccgtttgcaaaaaatgaggcgtttaactgtagcaatggagatgtgtttaaatggaaacatctgtggaaagtgttagcagaacagtttggccttgagttccacgaaccggaagggcaaggcctgtctctggagaaaatgatgaaggacaaaggtccagtgtgggatgagattgtacgcgagaaaggactggtgccgacgaagctcgaggaagtgggacaatggtggtttgcggatgttgtactctcagcgggtagctcattggatagcatgaataagagtaaagagcatgggttcctgggattccgcaactccaaatcctcgttcttgagttggatcgacaaaatgaaggcgtataaattcgtgcca

SEQ ID NO: 1293 - DNA, 1161 bp, Daucus carota
atgtcttggtggtggtcgggcgcgattggtgccgcccgcaaaaaactggaagaaaccgaggcccctccaaaatacgaaagcgtagcgcttgtgatcggcgttacaggtatcgttggaaattcattagccgagattctgccgctgagcgatacaccgggtgggccgtggaaagtatacggcgtggcacgtcgtccgcgaccatcatggaatgccgatcatccgattgaatatatccagtgcgacattagcaatactgatgaagcacagagcaagctgtcccaactgacggacgttacccacattttttatgtgacttggtcctcaaaaccgtccgaagcggagaattgcaaatcgaatggtcatatgttccgcaatgtcttgaatgccgtaattccgaacgcaattaatttaaaacatgtctgtctccagacaggccgtaaacactatctgggcccgtttgaattatatggcaaagtagcgcacgatccgccgtatagcgaggatttgccgcgcttgaatgttgagaacttttattatacattggaagatattctctttgaagaggtggaaaagaaagaaggcttgacatggagcgtgcatcggccaggcaatatttttggtttcagcccgtattctatgatgaatttaattggaacgctgtgcgtgtatgcaaccatttgtaaacatgaaggcgtcccaatgcgcttcccgggcgcgaaagccgcctgggagggttacagcgatgcaagcgatgccgacctaatcgcggaacatcaaatttgggcgagcgtggatccgtacgcgaaagatgaagcatttaactgtagtaacggtgacgtttttaagtggaagcatctctggaaagtattcgaagagcagtttgaagtgaaatgcgcggactttgaaggcgagggtctgtgtctggttgatctgatgaaagataagggcccggtatgggatgaaattgttaaagtcaatggtttaaccccgacgaaattagaagatgttgccatctggtggttcgtggatatggttttgggcatcgaatgccccttagacaccatgaataaatccaaagagcatggttttttaggcttccgtaactcaaaatcctctctgatcacgtggatcgatcgcatgaaggggtacaagattgtgcct

SEQ ID NO: 1294 - DNA, 1197 bp, Dendrobium catenatum
atgagctggtggtggtcgggcgcgatcggtgccgttaaaaagaaactggatgatgactttaacgccgcggcgggcaaatatccgtcggtaggtctggttatcggtgcgaccgggatcgtggggatgtccctggtggaaatcttgccgctaccggatacaccaggtggcccatggaaagtgtacgcagtgagccgccgaccgcgcagcagcctgctgccgccgccgtcggatggtttcgccgtggaaaccgtactgtgcgacatttccgatcctgcggacgcgagggccctgacgaagttgagtccgctgaccgatgtaacgcacctgttttatgtcgcgtgggcgaaccgcgaaagtgagacggaaaacatcgccgcgaacacggcaatgttgcgtaacgttctggacgtagtcgtgcctagcgctccgaacctgcagcatgtctgcctgcagacgggccgcaaacactatattggaagctttgattccctgggtaaggtgaaacctcatgacccgccgtttcacgaagatctgccgcgcctgccggcccccaatttctattacacgcaagaagatattctgttcgatagtcttcgcagtcgagatggcgccgtgacctggtccgttcatcgcccgacagcgattttcggctttgcaccgacctccctaatgaacattgtcggcaccttatgtgtttatgcgaccatttgtaaacgtgaaggcgagcctttacggtggcctggctcgcgcattgcgtgggaaggtttcagcgatgcctccgatgccgatttaattgctgaacaacatatttgggcggcagtagacccgtacgcgaagaatgaagctttcaattgctctaacggcgatgtgttcaaatggaaacatctctggaccaccctagcggaacaatttgaattagaggccgtgggatatattggagaagtcgaacgctttaagctggaagcagcgatgaaaggtaaggaggaactctgggaaaaaatcgtgcaagagaatcatctggtcccgacgaatcttgaagaagtgggcaactggtggtttgtggatattatgctgaacaatgaagaacacctggataccatgaacaaatcaaaagagcatggctttctaggattccgtaataccagaaatagcctgattagctggattgataaaatgaaaggttataaaattgtcccg

SEQ ID NO: 1295 - DNA, 1167 bp, Passiflora incarnata
atgtcatggtggtggtctggcgcgatcggcgcggttcgcaactcggaacagaacgacggcccgcgtagcttcgaaagcgtagccctggtagttggcgtgacaggtatcgtgggcaacagtctagcagagattttacccctcgcagacactccgggaggtccgtggaaagtatatggcgtcgcgcggcgtccgcagcctgattggaacgccgaccatccggtggaatatatccagtgcgacattgcagattcaaatgatgtgcagacaaaattgagtaaattggttgacgttacacatattttttacgtcacttgggcgaatcgtagcagcgaggcggaaaactgtcgcgtgaactcgctaatgctgcgtaatctgttggaagctctgattcctaacgccccaaacctgcgtcatatttgcctgcaaacgggtaccaagcactatgtaggtccgttcgagttagttctgcaacttgaaacccacgatcctccgttcactgaagatactccgcgtctgaacgcgcctaatttctactacaccttagaggatatcctgttagaagaatcaaagaaaaaggaaggcctgacctggtcgatccaccgtccggatattatcttcggctttagtccatacagtttaatgaatataatcggaagcttgtgcatttatgccgcaatttgcaaacatgaaggccagcctttactgttcccgggtactaaagaaagctgggaaaactatgcagtggcgtcggacgcggacttaatcgccgaacaggaaatctgggcgtgtgtggacccgaacgcacacaacgaggtcttcaactgccataacggcgatctgttcaagtggaaacatctctggaaagtgttggcggagcaatttgaaattgagaaatacgggttcgaagaacgcgaaaaacgtgttacgttagaagagcgtatgaaagataaaggcccggtttgggatggaatcgtacagaaacatcagctttcgagcacgaaacttgaggaaattggtgcgttttggtttccggacatcatcctgggtggctggagcaacatctcgtgtatgaataagtgcaaagaacacggtttcttcggtttccgtaatagcaagaattcctttatttcttggatagataaaatgaaagcatataaaatcgtgccg

SEQ ID NO: 1296 - DNA, 1182 bp, Prunus avium
atgagctggtggtggtctggcgcggtgggggctgccaaaaaaaaattcgatccgaacaacgcgccgaccaagtacgaatcagtagcacttgtggccggtatcaccggcatcgtgggcaacagcctcgcggaaattcttcctctgccggacaccccgggcggaccatggaaagtgtacggcgtggcacgccgtcctcgtccggactggaatgtagatcatcccgttgaatacattagatgcgatcttagcgatcctcatcagacccacagtgaactgtctcagttaaccgatgtgactcatatcttttatgtcacatgggcatcaaaaccaacagaagtggaaagctgcgaggcgaatgggaacatgttccgcaatctgctggatgcggtgattccgaatgcccctaatcttcagcatatttgcttgcagaccggacggaaacactacattggaccctttgagaagtggggcaaagtggaaccacatgaaccgccctttgacggcgatcttcctcgtctcaacgtgccatgcttttattacacgctggaggatatcctgtttgaagaagtcaagaaaaaagagggcctgacgtggtctgttcaccgtccgtccgttatttttggattcagcccgtacagtctcatgaatattgttggcaccttttgcgtttacgccgcaatttgtaagcacgaaggcaaaaagaaactgaaatatccggggagcaaaggcttttggaatggatactgggatgcgagcgatgctgacctcatcgccgaacatgagatctgggcggcggtggatccgtacgcgaagaacgaggcctttaattgctctaacggggacctgtacaagtggaaacatctatggcgcgtgttagcagagcagtttgacatggaatttgaggattttgacgatgatgatgagggcggtagccgtcctagcatgggtgaaatgatgaaagacaaaggcccagtatgggacgaaattgtgcgcgaaaacgggcttgtccccaccaaactggaggaaattgggaactggtggtttgtcgatgtgatgtttggcatcgagagctcggtggattcaatgaacaaaagtaaggaacacggcttcgtcggtttcagaaatagtaaaaccagcttcgtgacctggatagacaaaatgaaatcttacaaactcgtacct

SEQ ID NO: 1297 - DNA, 1164 bp, Daucus carota
atgtcctggtggtggagtggcgcggtgggtgcggcgcgtaagaccctgaaccaagataaagtaccttcgagttacgaaagcgtggcgctggtggttggtataacgggcatcgtgggcaacagcttggccgaaattctgccgctgcctgatactccgggcggcccttggaaggtgtatggggtggcgcggcgaccgcgccccccgtgggatgccaatcacccggtcgagtatattcagtgcgatattagcaacccggaagaaacacagtcgagtctatcacgccttaatgatgtgacacacttgttctacgttacctgggcgagccgttcaaccgaagcggaaaactgcgaaatcaattctaaaatgttccgcaatgtgctgaactgcattattccgaatgccccgaaactgcagcatatctgcctgcagacagggaaaaaacattattttggctcatttgaggcgagcggaattgcggcccacgatcctccctacagcgaggatctgccccgtctggagagtcccaacttctactataacttagaagatattctcttcgaagaagtaaaaaaaaaagatggactgacgtggtcggttcatcgccctgggaccatctttggctttagcccgcatagcatgatgaatatgatttgcacactctctgtctacgccgccatttgtaagcatgaaggtacagtcttacgttttcccggcaccaaggaagcgtggtcactgtatagcgaggcttcggatgccgacttgattgctgagcaggagatctgggctgcagtagatccgtacgccaaaaatgaagcattcaattgcagtaatggcgatgtctttaagtggaaacatttttggaaggtgctggcagaacagttcgaagttgaatgtggcgaatttgagggcgatgagcgcttaaccttagtagaattgatgaaagataaagaatcagtttgggatgaaattgttaaagaatataatctcgtgcccacgaaactggaagatattggcgtgtggtggtttgtggattatatactgggaattgagtatccgctagatacaatgaacaaatcgaaagagcacggttttctgggcttccgtaacagtaaaagcagctttattcattggatagataaactgaaagactcaaagattgtaccg

SEQ ID NO: 1298 - DNA, 1164 bp, Solanum tuberosum
atgagctggtggtggtcacgtgccattggtgcaaccaaagaaaaagtggaagaagatgacgtcccgaaaaaatgtcagagcgtgggtttaattattggggttactggtattgtcggcaatagtctggcggagatattgccgggcacagatacccctggtggtccctggaaagtgtatggtgttgcgcgtagaccgcgcccttcttggaacgtaaattatcccattgaatatattcagtgtgatatatcatcacccgaagaaacccagagtaaactgaccctgctgacggatgtgactcatgttttctatgtgacgtgggcgattcggccgaccgaactggagaattgtgaaatcaacggtaaaatgttccagaatgttctggatgcgatcattcctaattgcccgaatctgagccacatctgcttgcagaccggtttaaaacactaccacggctcattcgaattattcgaaaaaattgcccatgataccccgtatcatgaaggtctgccgcggcttccggcgccgaacttctactataccctggaagacattctcttcgaagaggtgaaaaaaaaagaaggactgacatggagcatacaccgcccgggcttgattttcggttttagcccgtactcgatgatgaatattatcggcactctctgtgtatatgccaccatttgcaaacatgagggcctgccgctgcgttttccgggttcgaaaagcgcctgggatggttatagttactgcagcgatgcagatctgatcgcagaacaccagatctgggcctcaatggatccaaacgcgaaaaatgaagcctttaatatcagtaatggcgatgtgtttaagtggaaacacctttggaaagttctggcggaagagtttcaggttgaagcagaggaattcgatgaatctaaacgttggacgctggttgagatgatgaaagataaaggccagatttgggacgaaattgtgaaagaaaacggtctggtcgaatcgaaactggaagagatcggtcgatggtggttcgttgatttggttctgaagaaagaatgcccgctcgacaccatgaataaaagcaaggaacatggttttctgggattccgcaacagcaagaatgcattcataagctggatctacaaaataaaagcgtgtaagtttgtcccg

SEQ ID NO: 1299 - DNA, 1188 bp, Setaria italica
atgtcgtggtggtggaccggtgccattggagcggtgaaaaaacgccaagatgaacaagccgccgcggcagagccgacgtatcaaagcgtggccctggtcgttgggtcgaccggtatcgtgggtaccagtctgctggacatcctgcccctggctgatacaccgggcggcccatggaaagtttacgcgctgtctcgtcgcccgctgccgccctggtctccgccgccgtcaccggccgttactcatttgcacctggacttagccgatgcggcggccgtagcggatgcgctgaagccccttacagatattacacatgtattttatgtcgcatggaccgcgcgccctaccgaagctgaaaaccgagaagcgaatgcggcgatgctgcgcaatgtgcttagcgtagtggtgccgaattgtcccgcgctggtgcatgtctgcctgcagacgggccgtaaacactatgttggcccgtttgaagcactcggcggagttagcttccctgacccgccatttacagaggacatgccccgcttagactgtccaaatttctattatgatatggaagatattctattcgatgaagtgaatcgtcgtgaaggtgccgtcagctggtccgttcaccgccctaccactgtatttggttacagtcctcgcagtgccatgaatgtggttggcagcctatgcgtgtacgcagccatttgtcgcaaagaaggtgcgaccttccgttggcctggttcgcgcattgcgtgggaaggcttttcagatgcgtccgatgccgatctgatagccgagcatgagatttgggctgctgttgacccttttgcgaaaaatgaagcctttaactgcagcaatggggatctgtataaatggaaatatctttggcctatcctagccgatcactttggcgtcgaatgggctggctatgaaggagaagaaaatcgttttaaactcgaagaagcgatggcaggtaaggaagccctatgggcagagattgtgcgcgaaaatgagctgatctctactgaacttgatgagattaccaattggtggtttgtggatgcggtgtttggtgtggagttcgaacacctggattcaatgaataaatccaaggaacatggcttcctgggttttcgtaatacggttaacagttttaacacctggatcgaaaagctaaaagtgtttaaaattgttccg

SEQ ID NO: 1300 - DNA, 1161 bp, Antirrhinum majus
atgtcgtggtggtatcgccgctcgattggcgaaacggaacagaaacgtatagaaattaacggcgtgagtccgacgtaccaaagcgtagctctgattgtaggcgtgacaggtattgccggcagcggcttggcggaaaccctgtcgttctcagatacccctgggggcccttggaaagtgtacggcgtggcgcgtcgtccgtgccccaaatggctggccaaactgaacgtgaattacgtacaatgcgacattgcgaacacggatgaaacctactctaaggtagctccgctgacagatatcacgcatattttttacgtcagctggaccggctcagaagatgtggctttgaacacgttgatgtttaaaaacattctggacagcgtcatcccgaatgcaccgaacctaaaacacgtcagtctccagacgggtatcaagtattattggggtaatatggccgaaatggatagcacgaatcaaccgcacgaatgcccgttttatgaaaacatgccgcgcctcaagcaggataacttctattacaacctggaagatttagtttatgacagcgcggttcgtaaaaacggcttgagttggagtattcatcgccctgcgctcatttttgggtttagcccgtgttcgatgatgaacactgtctcgactctgtgcgtctatgccgcgatctgcaaacatgaaaataagccactggtttacaccggtaccgaaacttcctggacctgtttatgggatgcagtagattcagacctgctcgcagaacatttcctgtgggcggcaacggtgccgaacgccaagaatcaggcctttaatattaacaatggagatgtgtttaaatggaaacacatgtggaaagtgctggcgaaagaatttgatatcgaagctataggctatgaaggcaaagaaccggtgctgctggaggatctgatgaaagataaagacagtgtttgggatgaaatcgtgaaaaaacatgacttagtaccaaccaagctgcgcgatatcgcagcgttttggttagccgacgtagtttttcgtaacaaagagaccctttgctctatgaacaaaaacaaggaatttggtttcatgggctttcgcgatacgactaagtcttttgtgtcgtcgatcaacaaaatgcgcgattttaaattcattcct

SEQ ID NO: 1301 - DNA, 1158 bp, Coffea canephora
atgactgcgaactggtggtggaaccgctctatttcacctcgcaaatgcgtagaaaacggtggacaaaaagaacacaacagcgcagcgctgattattgggattacgggtattgtgggaagcagcctggccgagatgctgctgctgcatgatactccgggaaacccttggaaagtgtatggtgtggcacgtcgcccgcgtccgacatggctgagtgacaaacgactgaattacatccagtgcgatattagtaacagccgcgaaacgattagtaaactttctcccttaattgatattacccatatcttctatgtctgctgggtaggtagcgaagattgcgatctgaacggttcaatgtttcgaaacgttttgcgtgtagtcattccgaatgcgcctaatctacagcacgtttgcttacagacaggcattaaatactacctaggtgtcttcgatgaacgatataaacaggagccgcatgaatcccccttcaccgaggatctgccgaggctgcctatcccaaatttttattatgaccttgaggatattctggaagaggaaaccaaggccaagctcggcttaacctggagcgcacaccgcccggcactggtttttggtttttcaccgtgtagtatgatgaatatggtttccacaatcagcgtgtatgcaactatctgcaagcatgaaaataaaccgttagtgtaccctggttccgatttctcatgggattgttattatgatgtagttgacgcagacctcctggcggaacagcagatttgggccagtatggaaccgaaagccaaaaatcaggcctttaactgtagtaatggcgacgtgttcaaatggaaacatatatggaaaattttagcggaacagtttggcctggagatggttgaatatcgaaaaggccagaaagaaacgagcatggcggaactgatgaagggaaaggaacctgtctgggacgaaatcgttaaaaaacacaaacttgtcccaaccaagttaaacgatattgcggcgttttggttagcggatgtggtgttttatagcgataaccgcgtttcgtgcatgaacaaaagcaaagaattgggcttcttgcgtttcaaagattcgacaaagagtttcctcgattcgatcgagaaaatgcgcgcgtacgggtttattccg

SEQ ID NO: 1302 - DNA, 1203 bp, Panicum hallii
atgacctcaagtatgagttggtggtggcgtggtgccccgttaaaacgtgaagatgaacaggttgccgcggcagcagagccaagccctttccagtcagttgcgctggtcgttggtagcaccggtattgtgggtactagcttggttgatattttacctctgccggacaccccgggtggtccgtggaaagtgtacgccctgtctcgcaggccgctgcctccttggtcacccccgccgccatcgagcgtaacacacttgcatttagacctagccgatcccgtggccgttgccgaagccctgacccctctgaatgatgtcacacatgtgttttacgccgcttggtctccgcgcgcaacggaagctcaaaaccgtgaagttaattcggccatgttgcgcaacgttctgagcgcagtagttccaagctgcccggcgattgtgcatatatcacttcagaccggcaccaaacattatatgggaccgccagaagccttcggtaggacagcggcactggatcccccgtacagcgaagatatgcctcgactggattggcccaacttctactacgaccaggaagatctgctgtttgacgcggttgcgcaatgcggcgatggcgccgccgtgagctggtccgtgcaccgccctaaccttatattcggtttctcaccgcgttctgcgatgaacattgtctgcagcatttgtgtttatgcggcaatatgccgcaaagaaggtgtgccgttacgttggccgggctcattaggtacctgggagggattttcatccgcgtctgatgcggatctcatcgcggaacaacaaatttgggccgccgtcgatcccacggccaaaaatgaagcgtttaattgctcaaatggtgatatttataagtggcgtcagctgtggccgatcctggccgaacgtttcggtctggagtgggtgggctacgaaggtgaagaaaatcgggtgaaagtcagcgaagccatggcaggcaaagaaccgttgtgggcggagattgtcaaggaaaatcagctggtgccgacgcagttgcatgaggttgcgaattggtggtttgtggatgcgctgttttctgttgagctcgagttcctggattcgatgaacaaatctaaagagcacggttttttaggttttcgtaatacgatcaaaagcttcaaatcatggattgatcgtatgaaagcgtacaacattgtgcca

SEQ ID NO: 1303 - DNA, 963 bp, Oryza sativa
atggtatccagcgcactgccgcgcggagagccggtcactcacatctgcgtggatctggcggatcccgcggcggtcagcgcggcgctggcacctcttacggatattacccacgtgttttacgtggcgtgggcgccgcatttttttgaagaagaccagaaccgcgaagcgaactcacgcatgctgcgcaacgtgctgagtgctgtggtgcctaactgtccggcgttggtacacgtgagtttgcaaaccggaagtaaacattacatcggcccaccggaatctattgggaaatttactatagaaactccgttttctgaagatatgccacggttggataactgcccaaacctgtactatgatcaagaagatgcactgttcgatgcggtgtcgcgctcgcgccgtcgcggcgcggcggtcattagttggagcgtacatcgtccttctctggtctttggtttcagcccgcagagtgctatgaatgtagtgtgcactttgtgtgtgtatgctgctatttgccgcaaagaaggcggtcgtaaactgcgctggccgggctctctaggtgcgtgggaaggtttttcaaatgcttcggatgcggatctagtggcggaacagcacatttgggcggcagtggaccccgcggcgcggaacgaagcttacaactgtagcaacggcgacgtgcgtgatggagtggtgggcgtccggggtggtggtgaacagggagagccggatgggggcggtatcgtgcgtgaagaaggcctcgtagccgccgcagaactggatcaggtagctaattggtggtttgtagatgcactctttatggataaatgggaatttctggacacgatgaataaaagcaaagaacatgggtttctggggttccgaaatactgttaagagctttggtacctggattgacaaactccgcctgtataaaattgtaccgagctgccgtatcgtgtccagcctg

SEQ ID NO: 1304 - DNA, 1191 bp, Setaria italica
atgtgggccggcgcaattggcgctgcgtggaaacgccaggacgaccgtgctgcggttagctcacagagtcagcaggcctttcaaagcgtggcgctggtcgtgggcagcaccggtatcgttggtgcgagcctggtggatatactgccattgccggacactccaggcggcagttggaaagtctatgcattgagccgccgctcgctgcctccctggtcacccccgtccagctcatctgtgacacatattaaagtcgacttgacggatagcgcagcggtcgctgaggctctaaccccgcttaccgacgtcacgcacgtgcatgtgttttatgtggcgctctccccgcgaccgacagaagcccagtcccgtgagaccaactctgcgatgctccgtaatgttcttagcgttgttgttccgaccgcccgccgcagcagcacggatcaggcgttgttacgtccacctcgtctgcaggatccccgtccgcgtgccgcggtgcataggggaggtgaggatatgccacgattggatatcccggtgttttactacgaccaggaggatgtgctgctcgatgcggttgcacgtggtgccgcctccgctgtatcttggagcgtacatcgtccgaatctgattttcgggttttttccacgtagtgccacaaatattatttgttctctgtgtgtttacgcagccatttgcctgaaagaggacatcaaactgcgctggccgggcactcgtagcgcctgggaaggattcaacacctgcagcgatgccgatttaatcgccgaacaacacatatgggcggcggtggaccccatggcacggaacgaagcgttcaattgtagtaacggggatatctacaaatggaagaaactgtggccggtgttagcgggacgatttggcctggaatgggctggctacgaaggcgaagagaaccgtttcaaagttgcagaagccatgactggcaaagaagccgtttgggcggcgattgttgccgagaacgatctggccgaaaccaaactggatgaagtggcgagttggtggctgattgatgcggtggccgaccagtatggtctggatcgtgagattctggactctatgaacaaatccaaagaacatggatttcttggctttcgaaataccgtgaagtcgtttaacacctggatagataaattaaaagcccataagattgtgccg

SEQ ID NO: 1305 - DNA, 1101 bp, Sesamum indicum
atgtatctggacaccacgagttggtggttcaaacgttcaatcggcgaagtcgataagaaaaaagtggaacctaacggagtggcgccgagctatcagagcgttgcgttgattgtaggcgtgaccggcattgcaggctcgggcagcgcgggcctggctaatctgcatgtcgaatacgtccaatgcgacattgcgaagacggaggaaacctatagcaaactgagccctcttaccgacattacgcatatcttttacgtctcctggacagggtcggaggactgtgagcttaatacattgatgtttcgcaacatccttgacgcggtgattccgaacgccccgaacttaaaacatcttagcctgcaaaccggcatcaaatattattggggtaatatggccgagatggactccagcaaccagccgcatgactgcccgttttatgaaaatatgccccgtctaaaacaggaaaatttttactacaacttagaagacctggtatacgaatcagccctgcgtaaaaactctttgacttggagcattcatcgtccggcgctgatttttggcttcagcccgtgttctatgatgaacacggtatctactctgagcgtttacgcggccatttgcaaacacgaaaacaagccgctggtatatactggtacggaagtgagctggacttgcttatgggatgctgtggacgctgatctgctggccgaacatttcttatggaccgcgacagatccaaaggccaaaaaccaagccttcaatattaacaatggtgacgtctttaagtggaaacacatgtgggacgtgttggcgcagcagttcggtctggaagccgttggatatgaaggtaaggagccggtcttgctggaagatttaatgaaagataaagaaggagtctgggatgaaattgtgaagaaacacgatctggtgccgacgaaattgcgcgatatcgcggccttctggctggcggacgtggtttttcgtaacaaagaaacgctgtgcagcatgaataaaaaccgtgaattcgggtttatgggctttcgcgatacgaccaaaagttttgtcaacaccatcaacaaaatgcgagcctatcgcttcatcccg

SEQ ID NO: 1306 - DNA, 1182 bp, Digitalis purpurea
atgtatactgatacgaccacctggtggtacaaaagatctataggtgacattgaacagaagaacgttgagaccaacggagtggccctgaactataagtctgttgccctgattgtgggtgttaccggcattgcaggctccggcttggccgaaactctttccaaaagcgacacgccggggggcccgtggaaagtgtatggcgtggcgcgtcgaccgtgcccggaatggttggccaaacttcacgtatcgtatatccagtgcgatattggcagtacagatgacacgtccgctaaactgagccccctgagcgacattacgcatattttttacgtgagctggaccggatctgaggactgcgataaaaatgcgatcatgttcaagaatatcctggactcagtcattcccaacgcaccaaatctgaaacacatttcgttgcaaaccggtatcaaacattattggggtaacatggtggatgaaatggataccacgaatgtgtctcacgattgccctttctacgagaatatgccccgcctgcgtcagcctaatttttactataatttggaagatctgctgtacgaagcgtgcggtacacagaacggtgcgctgacgtggacggtgcatcgcccggccctgattttcggtttttcaccctgtagtctgatgaatattgtagctaccctgagcgtttatgctgctatttgcaaatacgaaaataaacctctagtttacaccggtacggagacctcatggaattgtctggtagacgcggtggatagtgacctgctggcggaccatctggtgtggggtgccattagtccaaacgctaaaaaccaggcttttaatattaataacggagatgtatttaagtggaaacacatctggaaggtccttgcggatcagtttgaaattgaatttgttggttatgagggtaaagagccagtgagcttagaaggcctgatgaaagataaggattcggtatgggacgaaatcgttgaacgctatgacctggttccgaccaaactgaaagatattgccgcgttttggtttgcggatgtagcgttcagcattgaaggcgcggtgtcgtctatgaacaaaaacaaggaatttgggtttatgggctttcgtgattcaaccaagtcatttatcagcagcgtgaacaaagttcgtacctaccgctttgtgccg

SEQ ID NO: 1307 - DNA, 1188 bp, Digitalis lanata
atgtacaccgatacgaccacttggtggtataaacgctcaattggtgatattaaacagaagaacgtcgaaacaaacggagttgcccttaattacaaaagcgtggccctgattgtcggtgttaccggcattgcgggctcggggctagcggaaaccctcagtatgtctgatacccctggcggcccatggaaagtctatggcgttgcccgtcgtccatgtccggagtggttggccaaactgcatgtctcctacattcagtgcgatatagggagcacagatgatactagtgccaagctgtcgccgctgagcgatattacacatatcttctatgtatcctggaccggcagcgaagattgtgataaaaacgcgatcatgttcaaaaatatcctggactcggtaattccgaatgccccgaacttaaaacatattagtctgcagaccggtattaaacattactggggtaatatggttgatgaaatggatattaccaacgtgagccacgactgcccgttcaacgagtatatgccgcgtctgcgccagcctaacttttattccaacctggaagatcttttgtatgaagcatgtcgtacccagaacggtgccctgacgtggactgtccatcgtcctgctctgatttttggtttctccccgtgctcgctgatgaacatagttgccacgcttagtgtgtatgcggcgatttgcaagtatgaaaataaacctcttgtctataccggcacgcagacgtcgtggaactgtctggtggatgcggtagattcagatctgttgtccgagcacctggtctggggtgcgattagtcccaatgctaaaaatcaggcattcaacattaacaatggagatgtgtttaaatggaagcatatttggaaagtcctggcagaacaactccagctggaaatcgagtttgtcggctacgaaggtaaggagcccgtgagcttagaaggccttatgaaggacaaggattccgtgtgggatgagatggtggagaaatacgacctggttccaaccaaactccgcgacatcgccgcgttctggtttgctgatgttgcgttttcaatcgaaggtgccgtttcctcaatgaacaaaaacaaggaattcggctttatggggtttagggattcgacaaaaagcttcattagctcggtcaataaagtacgtagctatcgctttgtcccg

SEQ ID NO: 1308 - DNA, 813 bp, Nepeta mussinii
atggcctctacagcaaatccaatgcaagtaatgaaaaagaaattagagggaaaagtagtgatcgtcactggaggcgcttctggtatcggccaaacagcggccagagtcttcgcacagcatggcgcaagagctgtggttattgccgacatacaatccgaagtaggtaaatctgttgctaagtcgatcggtgatccttgctgttacgtacagtgtgatgtatcagatgaagaggaagttaagtcaatgattgaatggactgcttcagcttatggtggtttagatatgatgttttcgaatgttggcatcatgtccaaatcggcgcaaactgttatggacctagacctgttggagtttgacaaagtcatgagagtaaatgcgcgagggatggccgcgtgtttaaaacatgctgcaagaaaaatggtagaattaggcactcgtggaactattatctgtacaaccacaccattatcatcgaggggtggtcagtcaatgactgattacgcgatgtctaaacatgctgttatgggtttagtacgatccgcttcaattcagttaggcgcacacggtatacgtgtcaactgtgtgacaccatcagtagttcttacgcccctagctcaacgtatggggttagcaactccagacgattttcatacgcacttcggaaattttacctcgttgaaaggtgtgtatttgacaccggagcaagttgctgaagccgtggtatatttagcctctgatgacgcagctttcatcacaggacacgatttggttttggacggtggcttactgtgtctgcccttctttgcaccttct

SEQ ID NO: 1309 - DNA, 813 bp, Nepeta mussinii
atggcaagcactgccaatcccatgcaggttatgaagaagaagctagaaggtaaggttgttattgtaacagggggcgcttcaggaataggtcaaactgctgctagagtctttgcgcaacatggtgccagggcggttgtcattgcagatattcagtcggaagtcggcaaatcagttgctaaatccatcggcgatccatgttgttatgtgcaatgtgatgtgtccgatgaagaggaagtaaaatcgatgatagagtggaccgcttcagcatacggaggtttagatatgatgttttcaaatgtcgggataatgagtaaatcagctcagacggtgatggatttggatttgttggaattcgacaaagttatgagagtaaatgcgagaggcatggctgcgtgtctaaaacatgcagctagaaagatggttgagttgggcactaggggtacaatcatatgtactacaacaccactttcgtcacgcggtggccaatcgatgaccgactatgccatgtctaaacatgcggttatgggtctggttaggtcggcttctatccaactcggtgctcatgggatcagagtcaattgtgtaactcctagcgtcgtcctgacgcctctggcgcaacgtatgggcctagccacaccggatgatttccacacacatttcggtaactttacaagtctaaagggtgtatatcttacacctgagcaagttgctgaagctgtagtctacttggcctctgacgatgcagcctttattacaggacatgatctcgttttagacggtggtttgctctgcttacccttctttgcgcctagc

SEQ ID NO: 1310 - DNA, 963 bp, Nepeta cataria
atggctgataaagagggagaggtcgtatgtgtcaccgggggatcagggtttattggtagttggctagttagtctgttattaagaagaggttattcagtcagagcaaccgttaaaaacctaggggatgaaagggaaacgaagcatttagaagctattgaaggcgcagattcaaggctctctttattccaaatcgatttgttagattacgactcagtggctacagcggtcggagacgctgcgggtgtttttcatctagcgtctccctgcacgatcgaccaggttaatgatccacaaagggaattgttagatccggctattaaagggactcttaacgttctgaaggccgcaaagaacttaggcgtaagaagagtcgtggttacatcatcaatctctgctatgatcgctagttctaatagtttggctgaaacaggtgaagattgctggatagacgaggattactgtaggcaaaatggcttatggtatcctgttagtaaggctcttgctgaaaaagccgcatggaaactcgctgaagaaaatgggttggatattgtggtagttaatcctgggatggttgttgggcctatactacctcccgcgctcaactcatcaatgcaattaatgctacacgtcctacaaggtaaagatttctttgaagggttttttatgggcttagttcatgtgaaagacgtggctttggcccaaattttactctatgagaatacatcagccagtggaagacatttgtgtgtcgagtctctttcaagatacgacgattttgccaaacaaatggagaagttatacccagaatacaaactgcctagattctctaacaatgcccagcacggttctcttaagtcagatgccgcgctcaaaaaattacgtgatttaggtatagaatttgccccattggagcaaattgtaaaagattctatagaatcattaaggtccaagggttacatctct

SEQ ID NO: 1311 - DNA, 963 bp, Nepeta cataria
atggcagataaagaaggtgaagtcgtgtgtgttactggtggttctgggttcattggtagctggctggttagtctcctattgaggagaggttattctgttagagctactgtaaaaaaccttggcgatgagagagaaacgaagcatctggaggctattgagggtgcagatagccggttgtcactattccaaatagaccttttagattatgactctgtcgcaacggctgttggagacgctgcaggagtcttccatcttgcatctccatgcacaattgaccaagtcaatgatcctcagagagaattgctagaccccgcaataaaaggtacactaaatgtcttgaaggctgcgaagaatttgggcgtgagacgcgtagttgtaacgtcctcaatctcagctatgattgcctcttccaattcattagcagaaaccggtgaagattgttggatagatgaggactattgcagacaaaacggtctttggtatcctgtttcaaaggcattggcggagaaagcggcatggaaactagccgaagagaacgggttggatatagtagtcgttaaccctggcatggtcgtagggccaattttgccaccagccttaaactccagtatgcagcttatgctccatgtacttcaaggtaaagacttcttcgaaggattttttatggggttagttcatgtaaaggacgttgcattggctcagattttattgtacgagaacacatcagctagtggaagacatttgtgtgttgagagtttgagtaggtacgacgattttgcaaagcaaatggaaaagttgtatcctgaatacaaactaccccgcttctctaacaacgcacaacatggctctctcaaatctgatgctgcacttaagaaacttcgggatttgggcatcgaattcgccccactcgagcagattgttaaggatagcattgaatcattgcgcagtaaaggctacatttct

SEQ ID NO: 1312 - DNA, 963 bp, Nepeta cataria
atggctgacaaagaaggcgaagtggtttgcgtgacaggcggaagtggcttcatcggaagttggctggtttcactgttacttagacgtggctattccgtgcgtgcgactgtcaaaaacctaggtgacgaaagggaaaccaaacatttagaagctattgaaggtgcagattcacgactatcactgttccagatagacctactggattatgactccgtcgcaacggctgttggtgatgccgccggagtattccacctggctagcccctgtacaatagatcaggtgaatgatccacaacgtgagttattggatccagctatcaaaggaactcttaatgttttaaaggcggctaaaaaccttggagtaagacgtgtcgtcgtcacttcttcgattggtgcaatgattgcaagcagcaactcgttagctgagactggcgaggattgctggattgatgaagactattgcagacaaaatggcctttggtacccagtatcaaaggctttggcggagaaagctgcttggaaactcgcagaagaaaacggcctagatatcgtggtggttaatcctggcatggtggtcggcccaatattgccgcccgccctaaattcatctatgcagctcatgttacatgttctacagggtaaagacttttttgaaggtttttttatgggcttggttcatgttaaggacgtcgcattagcgcagatactactttatgaaaacactagcgcatcgggtagacatctgtgcgtcgaaagtctatcacggtacgatgatttcgcaaagcaaatggagaaactgtaccctgaatacaagttgccaagatttagcaataatgcacagcatgggtcattgaaaagtgatgcagctttaaaaaagctaagagacttgggtattgaatttgcgcctctggaacaaattgtcaaggattccattgagtccctacggagtaagggatatatcagt

SEQ ID NO: 1313 - DNA, 963 bp, Nepeta cataria
atggctgataaagaaggtgaggtcgtgtgtgtcactggtggttctgggtttataggatcgtggctggtttcgctgctcttacgtagaggatactcagtgcgtgcaaccgttaagaacttaggagatgaaagggaaactaagcacttagaggctatcgaaggtgctgattctagacttagtttatttcaaattgatttacttgattacgacagtgtagctactgcagtgggtgatgccgctggtgtgttccacttagcatcaccctgtactattgatcaagtcaatgatccacaacgtgaactgctggatcctgcgataaagggtaccttgaatgtattgaaagccgcaaaaaatttaggtgttcgcagagttgtagttacatcctcgataggtgccatgattgcaagttccaacagcctagctgaaaccggcgaagattgttggattgatgaagattattgcagacaaaatggtctttggtatccagtctctaaggctctagctgagaaggctgcttggaaactagcagaagaaaatggattggacatagtggtcgttaacccaggcatggtagtgggtcctatattacccccagctttaaattcctccatgcagttaatgcttcatgttttgcaaggaaaagattttttcgaagggtttttcatgggtttagtacatgttaaagacgtcgctttagcacaaatcctactatatgaaaatactagtgcaagcggtcgtcatctatgtgttgaatcactatccagatatgatgactttgctaaacagatggaaaaactgtatcccgaatataaattgcctcgtttttccaataatgctcagcacggctccttgaagagcgacgctgcattgaaaaaattaagagatctcggcattgaattcgcaccattagagcaaattgttaaggactcaatcgaatctttacgttctaagggttatatatca

SEQ ID NO: 1314 - DNA, 963 bp, Nepeta cataria
atggcagataaggagggtgaggttgtatgtgtcacaggaggtagtggtttcatcggcagttggttagttagtcttctattgaggagaggctactccgtcagagctactgtgaaaaatttgggtgacgaacgcgaaacaaaacatttggaggcaattgagggtgctgattctagattatcgttatttcaaatcgacttactagattatgattctgtagctactgcagttggggatgctgctggagtttttcacttggcctctccatgtaccattgatcaagttaacgatccacagagagagttactagatcccgcgattaaggggaccttaaatgttttaaaggctgcaaaaaatttaggcgtcagaagggttgtagtaacttcctcaatttccgccatgatagcaagttccaatagtctagccgaaactggagaggattgttggattgacgaagactattgtaggcagaatggtttgtggtatccagtttctaaagcgttagcagaaaaggcagcgtggaagcttgcagaagaaaacggtctagacattgtggttgttaaccccggtatggttgtaggccctatattacctcctgcgcttaactcatcaatgcaattaatgttgcatgtactacaaggtaaagacttttttgaggggtttttcatgggtttggttcacgtaaaagacgtcgcgctagctcaaatattgctttatgagaacactagtgcatcaggaagacacctgtgtgtggaatccctatccagatatgatgattttgctaagcaaatggagaagctgtatcccgaatataaacttcctcgttttagcaacaatgcacaacatggttcactaaagtctgacgctgcattgaaaaaactcagagatcttggcatagagtttgcccctcttgaacaaatagtcaaggactccattgagtcgcttaggtccggaggatatatctct

SEQ ID NO: 1315 - DNA, 963 bp, Nepeta cataria
atggcagataaagagggcgaagtcgtttgcgttaccggtggctcgggttttatcggttcttggttggttagtttactattaagaagaggctactcagttagggcaactgtcaaaaacctaggtgacgaaagagaaacgaaacatcttgaagcaatcgagggtgctgatagcagattgtccttatttcagattgaccttttggattacgattccgttgctacagcagtcggcgacgctgctggtgtgttccacctagcaagcccatgtaccattgatcaagttaacgatccacaacgtgaattgttggatccagctattaagggcactctgaacgtcctaaaagccgcaaaaaatttgggcgtgagaagggtcgtcgtaacgtcttctatttcagcaatgattgcttcatcaaattctctagctgaaactggggaggactgttggattgacgaagattattgtagacagaatggcctgtggtatccagtgtctaaggctcttgctgaaaaggctgcttggaaattagctgaggagaatggtcttgacattgtggttgtaaaccccggtatggtcgtaggtccaatactaccacccgctcttaattctagcatgcaattaatgttgcacgttttgcaaggaaaggatttctttgaaggtttctttatgggtttagttcatgttaaggatgttgcccttgctcaaattcttctttacgagaatacgtcagcttcaggtagacatttgtgtgtagaatctttgtcaagatacgatgattttgctaagcaaatggagaaactgtatcctgagtataagcttccgagattttctaataacgcccaacatggatcactgaaaagtgacgcagctttgaagaagttgagggacctaggaattgagtttgcgccattagagcaaattgtgaaggattcaatagaatctttgagatccggtggttatatctcg

SEQ ID NO: 1316 - DNA, 963 bp, Nepeta cataria
atggccgataaagaaggtgaggttgtgtgcgttaccggagggtctggttttattgggtcttggttggtatcattgttattgagaagagggtacagtgttcgtgcgaccgttaagaacttaggagacgaaagagagacaaaacatttagaagctatagagggggctgattctagacttagcctctttcagattgatcttttggattatgatagtgttgctaccgcagtgggtgatgctgctggagtctttcatttggcaagtccatgtaccatcgatcaagttaatgacccgcaaagagaactgttagaccctgccattaagggaacattaaatgtccttaaagcggctaaaaaccttggcgttcgaagagtagtcgtgacatcatcaattggggccatgatcgccagttctaattcactagccgagactggtgaagattgttggatagacgaggactattgtagacaaaatggtctgtggtatccagtttcaaaagcattagccgaaaaggctgcatggaaacttgcagaggagaatggcttggacatcgtcgtcgttaatccaggtatggtcgtcgggccaattttgccacctgcgcttaattcctccatgcagctgatgttgcacgtattacaaggcaaggactttttcgagggatttttcatgggactcgttcacgttaaggatgttgccttagctcagatattactttatgaaaatactagtgccagtggtcggcacttatgtgtagaaagcttaagcagatatgacgactttgcaaagcaaatggaaaaactatatcctgaatacaaacttccacgtttttctaataatgctcaacatggctccttgaaatctgacgctgcactgaagaaacttagagacctgggcatagaatttgcaccacttgaacaaattgtaaaggattctattgagtcactccgctctggagggtatatcagt

SEQ ID NO: 1317 - DNA, 963 bp, Nepeta cataria
atggcagataaagaaggagaagttgtatgcgtgactggtggttcagggtttattggttcatggttggttagtctattgttgaggagaggctattccgttagggccaccgtcaagaacttaggagatgaaagggaaactaagcacttagaggccatagaaggagcagattcccgcctgtcgctatttcagatagatttgttggattatgatagtgttgccactgctgttggtgacgctgctggagtctttcatttagcttctccatgtacgattgatcaagttaatgatccacaaagagaattgttggatcctgcaatcaaagggaccttgaatgttctcaaggctgcgaagaatttgggtgttagaagagtcgtggtcacatcaagcattggagccatgattgcctcatcaaactcattagctgagactggggaagattgctggatcgatgaagactattgcagacagaatggtttgtggtatcctgtgtctaaagcccttgcagaaaaagcagcctggaaattggccgaagaaaacggtctcgatattgtagttgtcaacccaggcatggtggtgggtccaatattgcctccagctttgaactctagcatgcaattgatgcttcatgttctacaaggtaaagatttcttcgagggttttttcatgggtttagttcatgtcaaagacgtggcattggcgcaaattttactatatgagaataccagtgcaagtggaaggcatttgtgcgtggaatcattatcaagatatgacgattttgctaaacaaatggaaaagctgtatccagaatataagctaccgaggttctcgaacaatgctcaacatggctctttgaaaagcgacgcggctttaaaaaaattacgtgatctgggtatcgaatttgcacccttggagcaaattgtcaaagattcaatcgaatctctaaggtcaggaggctatataagt

SEQ ID NO: 1318 - DNA, 963 bp, Nepeta cataria
atggctgataaagaaggtgaagttgtttgtgttactggtggttcaggttttattggttcatggttggtttctttgttattgagaagaggttactctgttagagctactgttaaaaatttgggtgacgaaagagaaacaaaacatttggaagctattgaaggtgcagattctagattatcattgttccaaattgatttgttggattacgattcagttgctactgcagttggtgacgctgcaggtgtttttcatttggcttctccatgtacaattgatcaagttaacgatccacaaagagaattgttggatccagcaattaaaggtacattgaacgttttgaaggctgctaaaaatttgggtgttagaagagttgttgttacttcttcaatctcagctatgattgcatcttcaaattctttagctgaaacaggtgaagattgttggatcgatgaagattactgtagacaaaacggtttgtggtacccagtttctaaagcattggcagaaaaagctgcatggaaattggctgaagaaaacggtttggatatcgttgttgttaaccctggtatggttgttggtccaattttgccaccagcattgaactcttcaatgcaattgatgttgcatgttttgcagggtaaagatttctttgaaggtttctttatgggtttggttcatgttaaagatgttgctttggcacaaattttattgtacgaaaacacttctgcttcaggtagacatttgtgtgttgaatctttatcaagatacgatgatttcgcaaagcaaatggaaaaattgtacccagaatacaaattgccaagattttcaaacaacgctcaacatggttctttaaagtcagatgctgcattgaagaaattgagagatttgggtatcgaattcgcaccattggaacaaattgttaaagattctattgaatcattaagatcaaaaggttatatttct

SEQ ID NO: 1319 - DNA, 963 bp, Nepeta cataria
atggctgataaagaaggtgaagttgtttgtgttactggtggttcaggttttattggttcatggttggtttctttgttattgagaagaggttactctgttagagctactgttaaaaatttgggtgacgaaagagaaacaaaacatttggaagctattgaaggtgcagattctagattatcattgttccaaattgatttgttggattacgattcagttgctactgcagttggtgacgctgcaggtgtttttcatttggcttctccatgtacaattgatcaagttaacgatccacaaagagaattgttggatccagcaattaaaggtacattgaacgttttgaaggctgctaaaaatttgggtgttagaagagttgttgttacttcttcaattggtgctatgattgcatcttcaaattcattagctgaaacaggtgaagattgttggatcgatgaagattactgtagacaaaacggtttgtggtacccagtttctaaagcattggcagaaaaagctgcatggaaattggctgaagaaaacggtttggatatcgttgttgttaaccctggtatggttgttggtccaattttgccaccagcattgaactcttcaatgcaattgatgttgcatgttttgcagggtaaagatttctttgaaggtttctttatgggtttggttcatgttaaagatgttgctttggcacaaattttattgtacgaaaacacttctgcttcaggtagacatttgtgtgttgaatctttatcaagatacgatgatttcgcaaagcaaatggaaaaattgtacccagaatacaaattgccaagattttctaacaacgctcaacatggttctttaaagtcagatgctgcattgaagaaattgagagatttgggtatcgaattcgcaccattggaacaaattgttaaagattctattgaatcattaagatcaaaaggttatatttct

SEQ ID NO: 1320 - DNA, 963 bp, Nepeta cataria
atggctgataaagaaggtgaagttgtttgtgttactggtggttcaggttttattggttcatggttggtttctttgttattgagaagaggttactctgttagagctactgttaaaaatttgggtgacgaaagagaaacaaaacatttggaagctattgaaggtgcagattctagattatcattgttccaaattgatttgttggattacgattcagttgctactgcagttggtgacgctgcaggtgtttttcatttggcttctccatgtacaattgatcaagttaacgatccacaaagagaattgttggatccagcaattaaaggtacattgaacgttttgaaggctgctaaaaatttgggtgttagaagagttgttgttacttcttcaatctcagctatgattgcatcttcaaattctttagctgaaacaggtgaagattgttggatcgatgaagattactgtagacaaaacggtttgtggtacccagtttctaaagcattggcagaaaaagctgcatggaaattggctgaagaaaacggtttggatatcgttgttgttaaccctggtatggttgttggtccaattttgccaccagcattgaactcttcaatgcaattgatgttgcatgttttgcagggtaaagatttctttgaaggtttctttatgggtttggttcatgttaaagatgttgctttggcacaaattttattgtacgaaaacacttctgcttcaggtagacatttgtgtgttgaatctttatcaagatacgatgatttcgcaaagcaaatggaaaaattgtacccagaatacaaattgccaagattttcaaacaacgctcaacatggttctttaaagtcagatgctgcattgaagaaattgagagatttgggtatcgaattcgcaccattggaacaaatcgttaaggattctatcgaatcattaagatcaggtggttacatttct

SEQ ID NO: 1321 - DNA, 963 bp, Nepeta cataria
atggctgataaagaaggtgaagttgtttgtgttactggtggttcaggttttattggttcatggttggtttctttgttattgagaagaggttactctgttagagctactgttaaaaatttgggtgacgaaagagaaacaaaacatttggaagctattgaaggtgcagattctagattatcattgttccaaattgatttgttggattacgattcagttgctactgcagttggtgacgctgcaggtgtttttcatttggcttctccatgtacaattgatcaagttaacgatccacaaagagaattgttggatccagcaattaaaggtacattgaacgttttgaaggctgctaaaaatttgggtgttagaagagttgttgttacttcttcaattggtgctatgattgcatcttcaaattcattagctgaaacaggtgaagattgttggatcgatgaagattactgtagacaaaacggtttgtggtacccagtttctaaagcattggcagaaaaagctgcatggaaattggctgaagaaaacggtttggatatcgttgttgttaaccctggtatggttgttggtccaattttgccaccagcattgaactcttcaatgcaattgatgttgcatgttttgcagggtaaagatttctttgaaggtttctttatgggtttggttcatgttaaagatgttgctttggcacaaattttattgtacgaaaacacttctgcttcaggtagacatttgtgtgttgaatctttatcaagatacgatgatttcgcaaagcaaatggaaaaattgtacccagaatacaaattgccaagattttctaacaacgctcaacatggttctttaaagtcagatgctgcattgaagaaattgagagatttgggtatcgaattcgcaccattggaacaaatcgttaaggattctatcgaatcattaagatcaggtggttacatttct

SEQ ID NO: 1322 - DNA, 1470 bp, Nepeta cataria
atgcagtataagttggcccttaatggtaagacattaaaaggtgaaactacaaccgaagccgtggatgctgctacagcagagaaggtattcaaacaatatgcaaatgataatggagttgacggcgaatggacctacgatgatgcgacgaagaccttcacagtcaccgaagcgttttgtaggtcctccctgctgttaagaaaagctctaggtggcagcaggagggctgcagcagctgctacctgttccagtgcttatgcttgtgggtggcaatctgagcgtgggcgttggtactctggtggagaaggaaccaccatctcagcgccaggttatcatgtgaacaccgcaccaagtcacatgactggcgcagtgttttgggacaaggacaagcctatcacatacgaggaattcgagatgcctaggccaaaagcgaatgaagtcctgattaagaccaaggcgtgtggtgcctgccattcagacttacatgtcattaagggagacctgaaatttccttgtccctgtattctgggacacgagattacgggcgaggttgttgagcacggtccgttgacagaaacaaaatatattgagagatatcccgtcggaagtaaggttataggtgccttcattatgccatgcggtagttgtttctattgtagccgtggcgaagatgacttgtgcgaaccttatttcgcatataatcgtgcaaaagggacgctgtatgatggacagaccagactttttcttaggggaagtgggaaaccggtacatatgtggtctatgagcggacttgctgagtactgcgtaacacctgtgaatggtctaggcgcactacctgacacactaccctacgccgaatcctctgttctgggatgtgcggtatttaccgcgtacggagcgatagctcacgcagctgaagtcaagccgggaaatagtgttgcagtgattggaataggtggggtaggctcctcctgtctgcaaatcgctaaggccttcggtgcctctgaaatcattgcagtcgatgtagaagacggcaagttagagacggctaaaacattcggcgctacgcacattattaattcaaggaaggaggacgcgatagccaaaataaaagaattgacggacgggagaggggttgatatcgccgttgaagccattggtggccctaaaaccttcgctcaatgcgtagggtcagtgcgtgctggcggaaaagccgttatgatcggcttaagtcccactgggggaaagggagaggtcgagataacgcaactggtgcgtagaaaggtgaaagtgatcggttcatatggtggtcgtgcaatgactgatttgccgaaactggtcgaacttgctgaacaagggacttttaatctagaagcagcggttactcgtagatataagttcgaggaagtcgcccaggcatatcaagatctgcaaaataaaacaatcgtcggcagaggcgtgatcgaaattatg

SEQ ID NO: 1323 - DNA, 957 bp, Nepeta cataria
atgtctcgggaaggggagggtaaggttgtctgcgtgaccggggcttccggctacgtggcttcgtggctggtgaagctcctgttgcagcgaggctacacagttcgagcaacggtgcgaaatctgtccgaccccctcaaaaccgagcatcttaaagcccttgacggagccgctgagcgactggaactgttcgaagcagatctggtgaaggaggggtcattcgacagcgttttccacggatgcgacggagtgtttcacaccgcctcgccggttatctttaggactactaaccctcaggccgacctcatcgagcctgccgtcaaaggcactgtgaacgttctgaggtcttgcaccaaggcttctagcgttcgaagagttgtactgacctcatccaccgcggctgttgttgtcaacggtagaccatttggtccggatgttgttgtcgacgagacatggttctcggatccacatttctgcgagaagaacaaagattggtattgtctctcgaagaccctcgccgaggaggccgcctggaagttcgccaaggagaacggcatcgatctcgtcgtgatgaaccccggtttagtgcttggtcctctgctacagcccactctgaacattacctctcaggtcttcttggatataatcaagggtaaacctatcgctccttactaccaatgtgtcgatgttcgagacctcggagacgctcacattctgggattcgaaaagagctctgcttcaggacgatacattttggtgggtaagaccattacccacctacagtttatgcaactgctccacaatctgtacccctcaattgttgacgcccctacttccgtcgcagacaaccccatcggtgaagtgtcgaagaagaaggcagaatcactcggcatgtcgtttatgcccctggaggtcaccgttaaggattccgttgaatcgctgaaggagaagaacttcctc

SEQ ID NO: 1324 - DNA, 972 bp, Nepeta cataria
atgaagcgagtttgtgtcaccggaggcaccgggttcatcgctagttggctcatcaagcgtttacttcataccggctactcagttaataccacagtaagaaagaacgctgacggcaaacgagacctgcgctaccttacgaacctccccggtgcctcagagaacctgaacatcttcgacgccgacctggatcagcctgactcgttcacccccgctatagagggctgtgtgggcgtgtttcacatcgtgcaccctatggaatgggacgagactgaatccgaggagacgaagaccaagcgagtgattggaggactgcttgcgatcctcaaggcttgtctcgatagtcccactgttcggcgattcatgcacacttcctcttcttctgccgtggtgtttgatggaaaggatctggacacgcgagatgaaacatcgtggtcacatctcgacctgatgcgaaacatgggccttcagggcaactcctacaccattaccaagactctcgcagagcgaactgctctcgagttcggaaagcagcatggtctggacgtgatctctttggtgccttcgtgggtccatggcccattcttcacgccgcgatgccccaacagcgtgctcgtgttcctggccttgattctgggcgacgaaaactactataagttccttatgaaggcaagtgtcgtccacgtcgacgacgtggctcgagccttcgtccatctctttgagtgccccgaggccgagggacgatacatttgttctgccttggaagttaccattgaggagctgtcagaatttcttagtcagcgatatcctcagttccacattcccaccgctgatagctttaagggtattgagcccgtcaaactgtgcggtctctcgtcgaagaagctgctcgagaccggattcaagtacgaatatgggctggaagaaatgtttgacggagccatccatagttgcaaggagaagggtattctctac

SEQ ID NO: 1325 - DNA, 999 bp, Nepeta cataria
atgggagaagaaaccaacatgaagggcaaagtctgcgtgaccggcggtacaggattcctcggatcgtggatggtgaagcgtcttctccagcatggctactccgtgaacaccacaacccggatccaagccggagagaaaaagcgcaacatcgactacctcagaaacttggccggagccagcgagcggctccacatttttgacgccgaccttgatcggcctgagtccttcagtgctgccatcgagggctgtgttggtgtgtttcacgtggcccaccctcttgatttcgaggaacgagagactgaggaggtgaagatcaaacgagtcgttaatggtacggtcggtatcctccaggcttgtgtagacgccaagacggtgaagcgagtggtttactgctcgtcggtggccactgcagtgttcaacgacaaggcagctacactggacaagatcgacgaatcatcatggaccgatgtagagtttctgcggtctcttggcgtgttcggcggagcctactcggttactaagaccctggtcgagcagactgtgctggagtttggagagcgaaacggtctggatgtggtggctattctgccatcgtggattcacggtccctttatctcgccgtactgccccgattccgtcagcatctgtatggctctcattcagggcgataagaagtcttaccagagactggtgagaacatctctggtccacgtggatgacgttgtcagagcccatatccacctcttcgagtacccccaggcgaagggtcgctacatctgctccaacgtggatatcaccattgacaagctccacgagttcctgaaagctaattaccccgagtacaagctgccgtccactgaagagttcgaggaccttattcctgtcgctttccccgagctttcttccaagaaattgctggaaaccggcttcaagttcgaaaacggactacaggagatgttcgacggcgcaataaagtcttgtaagaagatggggcttttg

SEQ ID NO: 1326 - DNA, 957 bp, Nepeta cataria
atggcggaaaagggaaagtgcgtatgcgtcacaggcgctggcggttacgtcgcttcttggctcataaacctgctgctctcgcagggttacaccgtgcatgccaccctgcgaaaccccggtgacgagaagaacggacacctccataaactcgagaacgccccccagaatctgaaactgttcaaggccgacctgttggatttcgattccattctcgctgccgttaaaggttgcgacggtctgttccacgtcgcttctccagccccgccggcttcggtccccaaccctcaggtcgagattgtggagcccgctgttaagggcactctgaacgtcctgaaggcctgtttcgaggcgtccgtatgccgagtcgttattgtgtctagcggtgtggcggttttcatgaaccccaactggccaaaggacaaggtgcttgacgagtcttgttggtccgacgccgaattttgcgctcgtactaataattggtattgttactcgaagacggcggccgaggcagaggcttggagctacgccgaaactaatggcttggtgctagtctcggtgtgtcccacgctagtcttgggaccaatgctgcagcagacgcccaacagttcgtctctgatcctcctgaagctcctcaaggaaggttatgaggtgaccgaggaccacgacagggtgatcgtggacgtgcgagacgtcgccgaggctatgaaactggtttatgagaaccgggaagccaagggtcgatacatctgtacatcacatacaattaagaccagggacctggtccagatgctgaagcaaatataccctaattaccactaccctaagtcatttaaagagggaaaagaacttcctcagctgtcttctggaaagctggaaggccttggatggaagtacaaacccttggacgagacactggtggactctgtggagaactacaagcagataggactactgatg

SEQ ID NO: 1327 - DNA, 987 bp, Nepeta cataria
atggagaaatccgtgaaggtctgcgtcactggaggcgccggctatattgcctcattccttatcaagcacctcctgcttcgcggatacaccgtccatgcaaccctccgggacctgggtgacgacagcaaggtcggcctcctgaaacgtctcgatcacgccgaaacgcgccttaaactgttcgccggtgacatgtacaacccgactgaatttgctgatgctatttacggctgcgaattcgtgttccacatcgctacgcccatgcaacacactgagggctctcagtacaagaatacctgcgaggcagctgtcgctggcgccaagatgatcgccgaatcctgtatcaagtctcgaaccgtcaagaagctcatttacaccgcgtcggtcaccgccgcatcccccttgaagggggacgcttctggatacgaggatgtgatggacgagacctgttggactccactgaaccactctttccagctacattacgactacgtaaacagcaagaccttggcagagaaggaagttctttcttacaatggcgcgggcatgggagtcgtttcactcgcctgcggtctggtgggcggtgagacgattcagtcctttgcctccggatcgatggcggtgcttatttctcaagccacaaacgatggtaccctgtacaaggcactccgcgaactagaggatctggactccaaggttccaatcgtgcatctgcaggacgtgatggaggcccacatgttcgccatggagaactctgatatgaacggccgattcctagttgcttctgattttctgaagtctgctcagatcgcctccctaatccaaaagcattaccctcatattaacatttcctctcagctgatcgaggacacaaagcgagaaacgaagtggggttcacgaaagttacaggatctgggtttcgagtacaagtgtgatgctgacaagattatttacgggagtatcgtgtgtgctaagaagttcggactcatt

SEQ ID NO: 1328 - DNA, 960 bp, Nepeta cataria
atggctgagaaagacaagactgtttgcgtcacgggtgccggcggcttcgttgcctcctggttggtcaagcttctgctatctcagggatacacagtccacggtaccgtccgaaaccccggcgatgagaagaacgcgcatcttaaacggctggacaacgctgcagagaacctcaaactgtttaaggccgacctgctagattttggttcaatcatcgaggccgtcaaaggctgcgtcggcgttttccacgtggcttgcccggtgccgggttcgtctgtccctaaccctgaggtagagttagttcagcccgcactgaatggaaccctgaatgtgctgaaagcctgctctgaggtgaaagtgggaagagtggttgttgtctccagtgtggctgcagtttcgatgattcgggactggccgaaggatcaggttatggatgaaaactgctggtcggacaaggagtactgcaaggaaaccaacaattggtactgttattctaagacggtggctgaggcggaggcctgggagtactctaagaagaacggtcttaacatcgtgaccgtctgcccaacactggtccttggtcccatgctccagcacatggctaacgcttcgtctacgtctcttattacaatgcttaaagagagtatctctgatatcgaaaacaacctccgaaaaatcgtcgacgtccgagacgtcgccgaggctctcaagctcgtctacgaaaagccggaagccgagggtcgatacatttgcatggcgcatatgattaagaacgccgatttgatggacatgctgaaaatcttttaccctaactacgactacccgaacgacgttaaggagggtaaggacgaaaagaaggtctcctctgagaagcttcaaaagctgggatggaagtttaggcccttgaaggagactgtggtggacagtgtggagtcttataagcagctgggcttcttgtggtcc

SEQ ID NO: 1329 - DNA, 987 bp, Nepeta cataria
atgtccattgccgctgctaagaccgtctgcgttaccggcgcttcgggatacattgcgagctggatcgtgaagttcctgctgcagaagggatacacggtgaaggcctctgtgcgtgaccctaacgatcagaagaaaacccaacacctcttggccctggacggtgccaaagagcgcctccacctgatgaaggccaacctgctggaagagggatccttcgactctgtcgtggacggctgtgacggcgtgttccatactgcttctccattttaccacgctgtcactgacccgcaggtggaactgattgagcccgctgtcaaggggacactcaacgtgctgggctcctgcgccaaggttccttcggtgaagcggattgtgctcactagttctattgccgccgtagcctacaatggcaagccgcggactcccgaggtcgtggtcgacgaaacctggtggtctgcgcccgacgtgtgtgagcagatgcagatgtggtacgtgctctccaaaacgctcgcggaagacgccgcctggaagtttgttaaggagaagggcattgagatggtgaccatcaaccccgccatggtcatcggcccccttctgcagcccaccctaaacactagctctgcggctattcttaacttgatcaacggcgcagagacttaccctaactcgacgttcggctggatcaacgttaaagatgtggcacgagcacacatcctggcgttcgaaaacacgagcgcttcaggacggtactgtctggtcgagagtgtcgttcatacgagtgaggttgttaaaatcctccacgagctttaccccacttacaaattgccagataagtgtgctgatgacaagccctttgtgccaacctaccaggtctccaaggagaaggccaagtccctcggtattgagtttactcctctcaaggagggtattaaggaaacggtcgagtctctgaaggagaaggatatgtttaaaccctcggcagccgtt

SEQ ID NO: 1330 - DNA, 930 bp, Nepeta cataria
atggcagagaagtccaagatcctgatcatcgggggaaccggctacattggaaaatttattgtggaggcctctgcaaagtctggccaccctaccttcgcattggtacgagagtctgctgtttctgatcctgccaagagccccttgattcagggcttcaaggattctggtgtgactatcctcattggagatttgaaagaccatgagtctctcctgaaagccattaagcaggttgatgtggttatctctactgttggccaaatgcaactcgacgaccaggtgaacatcatcgccgcgatcaaggaggccggaaacatcaagcggttcttcccctcggagttcggaaacgatgtggaccgaactagagctgtggagccggccaagtcagccttcgctgcaaaggctaagattcggcgagcaatcgaggcccagggaattccctacacttacgtctcctccaactatttcgctggctacagtctgcccactctggcacagcccggtgctttcgcacccccccccccccgagacaaagttgttatctacggcgatggaaacgctaaagctgtcttcaatggagaacacgacattggtacatacacaatcaaagccgtggacgacccaagaacgctgaacaagattgtgtacatcaagccccctaagaacacttactccttcaacgagttggtggctctgtgggagaagaaaatcaacaagacactggagaaggagtttattcccgaggaacaactgctcaagcaaatccaggagtcgcccattcccgtgaacatcattcttagtataaaccactcgattttcgttaagggcgatcagacctacttcaccatcgagccctcattcggcgtcgaagcctcggagctctaccctgacgttaaatacactacagttgaggagttccttgatcagttcgta

SEQ ID NO: 1331 - DNA, 1032 bp, Nepeta cataria
atggctgaagaggtctccaacaaacagatcattttcaacgactacattacgggtttccccaaggagtccgatatgatgttgaagacttccaccatcaagctcgaggttccggaaggttgcgacgacgttgttcttgtgaagaacctgtacctgtcgtgcgatccgtatatgcgttcccgaatgagtaaattagatgacaattacgtgcctatattcacccctggaagcccaataatgggctacggggtcgccaaagttgtggactcttgttcgcccaacttcaagaagggcgacctcatttggggcatgatcggatgggaggagtactcgttgattaagtccaccgacggcctctttaagattgagcatgaggacgtgcccctctcgtattacaccggaattcttggcatgcccggaatctccgcgtatgttggcttctacgagatttgttgcccccgtgagggagagaacgtctttgtatccgccgcttctggagccgtcggccaacttgttggccaatttgccaagttgctcggctgttacgtggtgggatcggccggaacccaggacaaggtcgacctcctcaagaacaagttcgggtttgacgaggcctttaattacaaagaggaagtcgatttaaatgcagcactcaagcgacattttccagagggtattgatgtctatttcgaaaatgttggaggcaagatgctggaggctgtcctcctcaacatgaacatgaagggtcggatcgccgcttgtgggatgatctctgactacaacctaaaggaagcccagggcgtcaaaaacctattttccattgtggcaaagcaaattcgaatgcagggattcctcgtgttccattactacagcctgtatccaaaattcctcgacttcattctccccctgatcaagcagggcaaaatcacatacgtcgaggacgttgcggagggtttagagtcggcgcctcccgcacttgtcggtctgttttccggtcacaacgtgggcaagcagctcgtccgagttgtaagtcag

SEQ ID NO: 1332 - DNA, 948 bp, Nepeta cataria
atggagaagaacgaacgcaaatccaagattctcatttttggcggcagcggctatattggcagctgtatggtgaagggttcgctgaagctgggacactccacctacgtcttctccagacctaactcctctaagaagcacctgcttaacgagttccagtctttgggcgctattattgtgaaaggtaagttggatgagcataacaagctggtctccgtcatgaaggaggtcgacgtagtgatttcagccttggcctacccccaggtgctggatcagttcaagatactcgaggctataaaggaggccggcaatattaaacgcttcctcccctccgactttggggtggaggaggacaagatttccgtgctccccccctttgaggagttcctagacaagaaacgtaagattcgtagagcgatcgaggagtctaagattccttacacgttcgtctccgcagatgtgtttggagcgtacttcatcaactacttgctccacccatacgaccccaacaatcatgagattactgtttacggatctggaagggctaagtttgtgatgaactacgaggaggacatcggtatttacaccattaaggtggcaaccgaccctcgagcttgtaaccgaacagtcatttacagaccaagcacaaacacactgactcagttagagctcatctctaagtgggaaaacaagatcggaaagaagttcaagaagatccatttcccagaagaggaggtggttgctctgagtcaaaaactgcctaaccccgacaatattcccgtggccattctgcatagtatcttcgttaagggtgtgactacttgttacgagttcgcagaggatgacgtggaagcttcttccctctaccccgatatgaaatttactactattgacgagcttttggacatctttctgcataacccgcccaagcccgcgtccgccgctttcgag

SEQ ID NO: 1333 - DNA, 1026 bp, Nepeta cataria
atggctaaagttgtcttggttactggcgcgtcgggatatctgggaggccgtctttgccatgctctcctgaaccagggatactccgtcaaggccttcgtccgagagacgtcggcactgtcttacctgccgccgccccgggacggcggagatggcggaggatccctccagctggtctacggcgacgttacggactaccccagcctcctcgaggcctttaccggctgtcacttggtatttcacacagcagcactagttgaaccgtggatccccgaccctgcccgatttattagcgtgaacgtcggaggtctgcgaaacgtgctcaaggcctacaaggaaaccgaaacaatcgagaagatcatatacacttcttctttttttgcccttggttctaccgacggttacattgccgatgagactcaggtccaccccgcgaagcatttctgtactgaatatgagaagtctaagacaatttctgataagattgccctcgacgcggccgctgagggcgtccccatcgtgccggtgtaccccggtgtgatctacggacctggaaaagtgaccaccggaaacagtgtcgcccatctgctcgtggaacgattttccggaaggatgcccggatacgttggaaaggagcagggtttctccttttgtcacgtcgatgacgtcgtccaaggccatctcgccgctatggccaagggcaagaagggtgaacgctatcttctcaccggcgagaatgcatcgttcaaggatgtgttcgacattgccgctgacattacccagacatctaagcctcagttccaaatccctctttttctcgtggacgtgtacggctgggtctgtatacttatctcacgaatgaccggaaagcttcccctcatttcgcccccggtcgtggacgtcctgagacaccagtgggcgtactcttgcgaaaaggccaagaaggaactggactacaaccccaggagtctgcgagagggccttctggaaatgctcccttggctcaagtcccttggactgatcaagtat

SEQ ID NO: 1334 - DNA, 972 bp, Nepeta cataria
atgggcaagattgtgtgtgttactggcgcctctggatacattgcctcttggctggttaagctcttgttgcaccgaggttatactgtgaaggctactgtgcgaaatctatcggatcggtctaaggtggcacaccttaccagtctcgaaggtgctaacgatcgactccacctctacgaggccaacctactcgaggagggctccttcgacacggcagtggacggatgtgagggtgtctttcataccgcctctcccgtgtcactgtctgtttccgacccgcaagctgagttgatcgacccagccgtgaagggtaccatgaacgtcctcaagtcctgcaaaaaggtgtccaccattaagcgagtcgtggttaccagctctatagcgagtgtgctgtacaactacgactctctgaatctaaaacacgatacaatcgtggacgagacctggttctctgaccccattttctgcgaggagaacaaggagtggtacgccctctctaagactttggctgaaaaggctgcatggaagtttgctgaggagaacggactggacctggtcactcttcatcccggctacacaattggtccttctctgcagcctactctaaatatgacctacgtggcattgctcaatttgataaaggagggaaagcagttgctcgccaacggcgtctaccgatacgtggacgtgcgtgacgtcgctctggcacatatcatcgctttagagaatccttcggcgagagggagatactgtctcgtaggacgagtcgcctattctttcgaggctctcgacattctccgaatgatgttccccactctgaagttgccccccatcgagaccaaggaccggccctcgaagcccccttaccacgtgtctaaggagcgagctgagagtctcggagtgagcttccgacccctggaggaatcgcttaaggactctgtcgaaagcttccgggatcgtaacctgattaccctt

SEQ ID NO: 1335 - DNA, 837 bp, Nepeta cataria
atgtctaccaagatggctgaagcgctcgaaccctggtctgacctcgaaggcaagaccgtcatggttaccggtgcttcctccggtcttggtcacgagttttgtttagacctcgctcgagccggctgccggatcgtggctgcagctcggcgtacagaccgcctcaagtctctgtgtgacgaaattaaccggatgcgaggaggaggatcgtgtcgagctatggctgtagaactcgacgtcactgccggtggccccaccattgcagcctccgtcgaccgagcctgggcagctttcggatctatcgataccctcattaacaatgccggtgtcagaggcgaggttaggtcatcgcttgagttgtcggaggaggaatggaactctgtggtcaagacaaacctgaacggctcttggctcgtatccaagtacgtgggagagaagatgcgcagggggggtggaggaggaagtattattaacatctcgtcgatctcaggcctgaaccgagcgcagcttcgaggcggaattgcctatagtagttccaaggcaggcctcgactctatgacaaagattatggctctggaactgggcgaccacaacatccgcgttaactcaatcgccccgggacttttccgctctgccatcaccgaagacctggtgaagaaagactggctgaagaacgtcgccgaacgatccgttcccctccggactttcggaacgtctgaccctgctttgacctcacttatccgatatttgattcaccactccagctcttacgtctccggaaacatctttattgtcgatgctgggtatactctccctggctacccaatcttctcctccctg

SEQ ID NO: 1336 - DNA, 1032 bp, Nepeta cataria
atggaggagaacctggtaggcaacaagcagatcatcttcaagggctacatcgagagagtccccaaggaatctgatatggaattgaagttgggcaataagattaaactcgaggcccctgagggatctggtgctttcctcgttaagaacctgtacctctcctgcgacccctacatgcgaggtcgaatgcgagattttcacggatcttacatacccccctttctaccaggcagcgtggtggagggattcggtgtttcaaaggtaatagactctgataaccctaacttcaagccgggcgacatcgtctctggctttaccggttgggaggaatactccctgcttcacaacacagagcagctgcggcgagtggagcccgacaacatccccctctcctatcacatcggcttgcttggaatgccaggattcactgcctacgccggcttctacaaagtctgtgaccctaagcgcaacgagcatgttttcgtctctgccgcgtcgggagctgtgggacaactcgtcggccaactcgctaagttgcacggatgctacgtcgtgggctccgccggttccgaccaaaaggtggacctgctaaagaaaaagctgggtttcgatgaggcgttcaactacaagcaggagcctgacctggacgccgccctcaagaagtatttcccagagggcatcgacatttacttcgagaatgtcggtggcgccatgctggaagctgtgctgctcaacatgcgagttcatggacggatcgcagtctgcggaatggtctctcagaacggaatggacgaacagggaatcagaaacctgttttcgctcatccccaaaagagtgcgcatgcagggtttcctgcagtctgactacctccatctgtttcctaagtttgtagaagaggtcggaaacctgtacaaagaaggtaagattacatacctggaagacatgaaccagggcctcgagagtggcccctgcgcattcgctggcctgtttagtggaatcaacatcggtaagcaggtcatctgtgtgtcgcctgcc

SEQ ID NO: 1337 - DNA, 963 bp, Nepeta cataria
atggccgataaggagggagaggttgtatgtgtgacaggaggtagcggatttattggatcttggctggtgtcccttctcctccgacgaggatactcggttcgcgccacagtgaaaaacctcggtgacgaaagagagactaagcaccttgaggcgatcgagggagctgactctcggctgtcgctcttccagattgatctgttggactacgactccgtggctaccgccgtgggagacgccgcgggagtcttccatcttgcttctccctgcactattgatcaggtcaacgaccctcagagagagctcttggaccccgccatcaagggcacgctgaacgtgctcaaggctgccaagaacctgggcgtcagacgagttgtcgtgacttcctccatctccgccatgattgcttcgagtaactctctggccgagacaggagaggactgttggattgatgaggactattgccggcagaacggactgtggtaccccgtgagtaaggctctagccgagaaggccgcctggaaactcgctgaagagaacggcttggacatcgttgtggtaaaccccggcatggtggttggacccattctaccgcccgctctgaactcctccatgcagctgatgctgcacgtgttgcagggcaaagactttttcgagggattttttatgggcttggtccatgtaaaagatgtggctctcgctcagatactgctttacgagaacacctcggcctctggacggcatctctgtgttgagtccctatcgcgatacgatgattttgctaagcaaatggagaagctctaccccgaatacaagctccctcgattcagcaacaacgctcaacacggatcactcaagagcgatgccgcgcttaagaagcttcgtgacctgggcattgagttcgcacctctggagcagattgtgaaggattctatcgagagccttcgttccaaaggctacatttcc

SEQ ID NO: 1338 - DNA, 945 bp, Nepeta cataria
atggctgacgctgtcgtccaacccgccgctcagcgatatgccctcataaccggcgcgaacaagggaattggattccagatttgccgacaactcgagtctaagggtatcgtagttatcttggcctcccgagacgaaaagcgaggaattaaggcccgagaaagactcctaaaagagttcggcgtgagttccgataatgtcgtcctgcaccagctggacgtggttgacccggcaagcgtggctgctgtttacgagttcattgaatctagattcggccggctcgatatcctcgtaaataatgctggaatacgcggcgctgacgtcgacggcgatgtgtcgttgctagaagagtacattaaggccgacggcgctactatcagcgccggtggtaaggctgagcccttccatcccaaagccaacggccggctcgtcgagactttcgagaacgcagaggaatgtattgagaccaactactacggagccaagcgcgtcactgaggccctgctacctctcttgcaccagtccgacagcccgcgaatcgtgaatgtgtcttctcttctggggtcactggtgttgcagacgaacgagcgagcaaagggtgttttctctaacgaggagggcctgacccaagacaaggttgatgaggtcgtccaagagtttctgaaagattttaaagagggaaagcttgaggagaataactggcctcctcatttccctgcgtacaaggttagtaaggaggctctcaacgcctacaccatgctcctggccaagcggaatccttctttctgtaccaacgccgtgtgccctggattcagtcgaacagacatgaccttcaactctggcctgatcagtgagtcggaggctgccgaggcccccgtcaagcttgccttgctgcccgatggaggtccgagcggttcatttttctaccgggaggaggccctctcactt

SEQ ID NO: 1339 - DNA, 930 bp, Nepeta cataria
atgaaggcctggacttacaaggagtatggcggcattgaggtgctcaagctggacagtgatgtgccaattccggaacccaaggcggaggaggttctgatcaaggtagcggctgtgggcctcaacccaattgatttcaagagacgactgggattttacgaggcagacagagcccctttcccggtggtgccgggatacgacgtggccggcgttgtggtgaaggtcggtaaccgagtgatgaacttcgaagagggtgacgaagtttacggtgacgttgtggagactgccctgcaggatccccgttccctagggaccctggcggagtatacgatcgctgaggagaagctgctggccctgaagccccggaatctggattttgctgaagcggcctcgttgcctgtcgctatccagacggcctaccagggtctagagcgtgctcgattctcggagggaaagtctatccttgtccttggcggcgctgggggtgtcggttcgcttgtcatacaggttgcccgctatgttttcggcgcttctaaaattgccgccacctgctcgacagcgaacatggaccttgttgagtccttgggcgccgacctcgtgatcgactatagtaaccacaattttgaaaattatcccgacaagttcgacgtcgtcttcgacacaatcggccagtctgacagagccactaaggccctgaaagagggaggatgcgtggttgtgatcgtcggcgagcacgtggatccccctatgttctcttttaccctaactgcttccggagagtacctcaatatgttgaacccctacctcgagaccggcatgctgaagcctgtcttagaccccaacggcaccttcccatttgaccaagtgaacgaggccttctcatatttagagagcaacagggccataggcaaggtggttgtgtatcctatttca

SEQ ID NO: 1340 - DNA, 549 bp, Nepeta cataria
atgagcaagtccttgggcttcatgaaatcggttaggccaatcgccctacccttaatttgcttgagtgaacttatctccacccccattattttggatgctcctagagcactcgccccaagtactacagcaaaccccaccgcaccaagaccgaagacggcaactgtagatccatctagtacatcagctgtattccatactgcccctagacctgtagaaacaccacaattaagccgtgttatcttctcaaaagaagcattacgttccattctaacgacacaagccgaatccagtactgtttattctttaaacgtggaagttttaagaaaatggaaaattggatttccgtcatttgttgagaacaggcactttccgtccccagttatggtattgtttataggctttacattgtacttctggcataagctagtcttttttgatttacagtatacacaattttggcactctccactcaaaataggcacgatgtggtcaccaataagtatttcacttactccctcaccaacgctatctacgacaccagaggccagt

SEQ ID NO: 1341 - DNA, 564 bp, Nepeta cataria
atgtcttcaatccctcagcgtcttgcaatggattttccaaccagcataactaaacgttatcttacatctgatcttgcctctcgttcaatcgcagtcttcactagctcgatgccgattagttcaatgtctgctgttatgccttgttttcctcaaaagtcgaatatctcctgcgtatcctttactcctccaaagtccttgcccccaatgagttttcgtccagctactcgtggtaaaatcggaagaagtagaggtttattgggtaaccctacggtgattagctttccgtttatttttaacagattatctaacggggtcaactggtgcactgcagcaatggtatcaatgatgaagagcatcgtgccagtcgctgcattttcttgttctgcctctgtactaactactaaggcatctgcaccatctctttttatggcttcaatttttttttttggcgatgttctgatcacggtgacatttattcccaaagcatttcctaatctaacggctacatggccctccccaccttcgcctgctacaccaaaatgttttcccgctagtgttattcca

SEQ ID NO: 1342 - DNA, 564 bp, Nepeta cataria
atgtcatcatccccacaaagattagccatggattttccaacttcaattactaagaggtatttaacgtctgacctggcctcacgatctatagctgtatttacatcttctatgccaatttcatcaatgtctgctgtgatgccctgttttcctcaaaagtctaacatttcttgtgtgtcctttacgcccccgaaatctttaccaccgatgagctttcgcccagccactaggggtaagataggcaggtcccgcggtctgttgggtaatccaacagttatttcttttccatttatctttaatcgtttgtcaaatggtgttaattggtgtactgctgcgatggtctctatgatgaagtcaatcgttcctgtagccgctttttcctgttcagcatcagtattgactacgaaggcttcagcaccaagtctattcatggctagtattttctttttcggtgatgttctgataaccgttacttttatcccgaaggcttttccaaatttaactgcaacatggccatcgccaccaagccctgcaacaccaaagtgctttccggccagcgtcatccct

SEQ ID NO: 1343 - DNA, 1146 bp, Nepeta cataria
atgtcgtctacaaaaggccaagtaatcagatgtaaagctgctgttgcttgggaggctggaaaaccactagttatagaagaggtggaagttgcacccccacaaaaaatggaagtaagggtgaaaatactatttacgagcctttgtcacacagatgtttatttctgggaagcaaaagggcagacaccattgtttcctagaatttttggtcatgaagccggtggtatagttgaatcagttggggaaggtgttaccgaactggcacctggtgatcacgttttacctgtctttacaggggagtgcaaagaatgtcgacattgtaaatccgcagagtccaatatgtgtgatttgttgcgcattaacacagataggggagtcatgattgaagatggtaaatccagattttcgaaggatgggaaagaaatctatcatttcgtagggacttctactttttctgagtacacggtagttcatgtgggttgtttagctaagattaatccagcggctccaatggataaagtttgcattttaagctgtggtatatcaactggattaggtgcctctttgaatgttgctaaaccaacgaagggttcaacagttgctatcttcggtctgggagctgttggcttggctgcagcggaaggtgctaggatagctggtgcttcaagaatcattggtgtcgatctaaatgccaacaggtttaatgaggctaaaaagttcggggttaccgagttcgtgaatccaaaggatcatgaaaagcccatacaggaggttttagtagaaatgaccgatgggggagttgaccgctctgtagaatgtactggtaatgtgaatgcgatgatcagcgcatttgaatgcgttcatgatggctggggcgttgctgtgttagttggtgttcctaataaggatgatacgtttaagacacacccagtaaatctcttgaacgaacgaactttgaaaggcactttcttcggcaattacaaaccaaggacagacatccctgtagtcgtagaaaaatatatgaacaaggagatggatttacaacttgaaaagtttatcacacatcgtattagcttcagtgagattaacaaagcctttgactatatgttgagaggtgaatcaattagatgcattattacaatggaaaac

SEQ ID NO: 1344 - DNA, 981 bp, Nepeta cataria
atggaagtcagaattagagttctcttcacttcgatttgtcatacggatctgtctgcgtggaagggcgaaactgaggcccatcgcgtataccccagaatattcggacatgaagcatcgggtgttgtcgaatccgtcggtgaaggtgtctccgatattgagattggtgaccacatagtgccaatttttaacggtgaatgtcaaaactgtgtttattgtaaatcaaagaagacgaacttgtgtcaaaaatatcgtgtgaacccaatgaaatcgactatgactggtgatggtaagtgtaggttttccacgaaagagggtaatccaatttttcatttcttgaacacttcaacattctccgaatatactgtactagatagtgcgtgtgtagttaaaatagaccgcaaagcctcacttgaaaagatgacacttttgtcatgtggggtctctactgggttgggtgcagtttggaatactgccgatgttgaggagggtagcactgtagccgtgtttggcctcggagctgttggtcttgcggtggtggaaggagctagagctagaggagcatccagaattatcggtgtggacattaattccgataaacaaattaagggtcgcgcaatcggactaaccgacttcattaaccccaaagatttagatatcccagttcatcagaaaataagagaaatggccaacggaggtgtcgactactcctttgaatctgcgggtaatttagatgtccttagagaagcgtacttatccactcacgatggttggggttttactgtgattttgggtattcatccaaccccaaggatgctcccgcttcaccccatggaattatttgatggtagaagaattgtggcctcggttttcggagattttaaaggtaaatcccaactcccacattttgccaatcagtgtatcaagggcgaagttaagcttgatgaattcattacacatgaaatcgatagaaagtccgtggtg

SEQ ID NO: 1345 - DNA, 720 bp, Nepeta cataria
atgaaatcgactatgacaggcgatggcaaatgcagattctccactaaagaaggtaaccccatttttcatttcctaaacacttcaactttctctgagtatacagttctggatagtgcctgcgttgttaagattgataggaaagcttctttagaaaaaatgacattattgtcatgtggagtctctacgggccttggcgcagtatggaatactgcggacgttgaagagggatccactgtggcagtttttggtctaggtgctgttggattggcggtcgtagagggggctagagcaaggggtgcttctagaataattggagtagacattaacagtgacaaacaaataaagggacgtgcgatcggcctaactgatttcataaatcctaaggatttggacatcccagtacaccaaaaaataagagaaatggccaatggtggtgttgactattcttttgagtctgctggtaacttggatgtactgcgtgaagcatacctgtcaacccatgatggttggggtttcacggtgatattaggtatccaccccacgccaagaatgctacctcttcatccgatggaattatttgatggtaggagaatcgttgcatctgtctttggggattttaaaggcaagagccagcttccacatttcgctaatcaatgcattaaaggtgaagtcaaacttgatgagtttatcacccatgaaatagatagaaaatccgtggtg

SEQ ID NO: 1346 - DNA, 843 bp, Nepeta cataria
atgccatgtggtagttgtttcttttgttctaaaggtcaagatgatctatgtgagtcgttttttgcatataatcgggccaagggaactttatatgacggggaaactagactgttcttacgtggttcaggtaaaccagtttatatgtattctatgggcgggttagcagaattttgtgtggtaccagctcatggtctcacatctcttccaaatacattgccatacactgaatctgccgtattaggctgtgccgtctttactgcatacggcgcaatggctcacgcggcccaggtcagacccggtgactctgtcgccgtaatcggtataggtggagtgggaagctcctgtttacaaattgcaaaagcttttggtgcttctgaaatcatcgctgttgacgttcaagatgagaagctggagaaggctaagatcctgggcgcgacccacgccatcaattcaagaaaggaagacgcggttgccaagatcaaagaaataacaggcggcagaggcgtcgatgtagctgtggaggccctaggtcgacctcagacattctcccaatgtgttcaatgtgtccaggacgggggtaaggccgtgatgattggcctaaccttaagtggtgcgaaaggtgaagtagatataaatcacttagtgaggcggcaaattaaggttattggatcgtacggtggccgagcccgtcaagacttgccgaaattagtcaaattggctgaaaaaggcacctttaacttgcaagctgcagtttccaggaaatataagtttgaagaagttgaggaagcgtataaaaatttggatcaaggatcgattgtaggtagaggtgttgtggaaattatg

SEQ ID NO: 1347 - DNA, 1065 bp, Nepeta cataria
atgggttcgcatggagaggaagaaaacatggcagcatggctactggggattaacaatctgaaaatacttcctttcaaattacctttgttaggtccgcatgacgctaggatcagaatgaaagccgtgggtatttgtggttctgatgttcattacttgaaagaaatgaaactggcagattttatagttactgaacctatggtgatagggcatgaatgtgcaggcatcgtcgaggaggtcggagctgaagttaagcatctcgtgccgggtgacagagttgctatcgaacccggaatttcttgctggagatgtaatctatgcaaggaaggccgttataacctttgcccagaaatgaaatttttcgccacgcctccagtccatggttctcttgctaaccagatcgttcatccagcagacttatgtttcaagttgcccaataacgtgagcttggaagagggggctatgtgcgagcccctatctgttggtgtgcatgcatgccgtcgtgcaaacgttggtccagagaccaacgtcttggtaatgggggctggtccaatcggtttggttaccttgttgtcagctagagccttcggttcgccgcgtatcgttattgttgatgtagacgatcatagactgtctgtggctaagtcattaggtgcagatgaaactattaaggtaagtacgaacgtcaacgatgtgggtgctgaggttgaatgcataaaagccgcaatgggtggaactatagacattgcacttgattgcgcaggtttttcaaagaccatgagtacagcgctggctgcgacttctagtggtggtaaagtgtgtttggtaggcatgggccatactgaaatgacggtgcctttggcccctgctgccgttagagaagttgacttggttggaatttttcgctataaaaacacttggcctttgtgcattgaattcttgcaaagcggcaagattgacgtgaaaccactcatcacgcatcgttttggttttagtcaaaaggaagttgaggatgcttttgagacatcagcaagggggggaaccgcaattaaagtaatgtttaatcta

SEQ ID NO: 1348 - DNA, 1065 bp, Nepeta cataria
atggctaagagcgttaatgcagtcggttgggcggcaagagacacctcgggtgttctgagtccacttaagtttgcaagacctgctgctggcgacagagacgtgcaatttaaagttctttattgtggcatatgccattccgatctacattccatcaaaaatgaatggggacacacacaatatcccattatacccggtcatgaaattgtaggtgtcgtgacagccgtagggccgaaagcaaccaaatttaaagcaggcgataaagtcggagtaggatgtctagtcaacagttgccgtaattgtaatcaatgtgcagctgatcttgaaaattattgtccaaagattgtccaaacttataactctgtacttgctgatggtagcgttacttatggtggctatagtgatgtgatgactgcagatgaagacttcgttatcaggtggccggaaaacttccctatggataaaggtgcccccttgctttgtgccggtgtaaccacttactccccattgagatattatggtttggacaaacctggattacatatcggtgtggtgggactgggcggtttgggtcatgtggccgttaaattcgcgaaggcttttggtaccaaagtcacagtcatctctactagtgctgggaaaaaaaaggaggctattgagacccttggcgctgatgcattcctaatatccaaagacgcatcagaaatgcaagctgcagctggtaccttggatggcatgattgatacagtctccgctcaacaccccttaccacctctattgtcattattgaaaccacatggtaagttaatactggttggtgccccagagaagccattagaattaccagcatttccattattgatgggtcgaaagatggttgctggaagtattattggtggtataaaagaaactcaggaaatgatagactttgccgctaagcataatatcttgccagacgtcgaaatgattcctatggattatgtaaataccgcgatggagagattggcaaaggcagatgtaaaatataggtttgttattgatgtcggtaatactttaacaaaagctgat

SEQ ID NO: 1349 - DNA, 1077 bp, Nepeta cataria
atggctaagaccccggagacagagcacccagttaaagcttttgggtacgccgccacggataattcgggtaccttctcaccattcaagttctctcgtagggctacaggagaacgggacgtacagttcaaagttttatattgcggcgtatgccattctgatttgcatatggtaaaaaacgaatggggtgtcacacattatccaattgtccctggtcatgaaattgttggtgtcgctacagaagtaggttccaaagttgagaaagttaaggtcggcgataaggttggtgtgggtgtgattgtaggttcttgtcgtcaatgtgatcaatgttctaatgatttagaaaattattgtagcaagcaaattttaacatatggtgctccgtacctggatggcacgattacaaggggcggttattcggacattatggttgccgatgaacatttcatcatccgctggccggagaattttcctttagatgcgggtgcaccattattgtgcgcaggcattaccacttattcacccctgcgctacttcggtcttgacaaaccaggcttaagagttggtgtaaatggtctagggggtctgggtcacgtggcagttaaatttgccaaggcttttggtactaaagttacggttatctcatcgagtttgagaaaaaaaaaagaagcggtggaaaagttaggtgtagacgaatttctggtatctactgatcctgaacaaatgcaagccgcaattggtaccttggatggcatcattgacacagtgtctgccgaacattccgttgtatcattattgtcattgcttaaaccgcatggaagacttatcgtagtgggtgctcctgaaaagcctcatcaattacccgcttttccattgattactggaagaaagtccatctccggatcggccatcggtggtatgaaggaaactcaagaaatgatagatttcgccgctaaacataatattctgccagatgtagaagttattccaattgactatataaatacagcaatggaaaggcttttgaagtccgatgtgaaataccgcttcgttatcgacgttgaaaaatctttgaaagct

SEQ ID NO: 1350 - DNA, 948 bp, Nepeta cataria
atgtatcctgttgtccccgggcacgaaattacaggtataattactaaagtagggagtaatgtcaccggttttaaagtgggggatagagccggcgtgggatgcctggctgctacatgtcttaagtgcgagtgctgccaggaaggtcaggaaaactattgcgacgacgttcagttcgtgtataatggtattttctgggatggttccataacttacggaggttacagtgacttcttagttgcagatcatagatatgtggttagagtgccggaaaatttaccaatggatgctgccgcccccttgctatgtgctggaattactgtctatgctccaatgaaggacaataatctacttgaaacaaagggtaaacacgtgggtgttgtggggttgggtggcttgggacacattgctgtgaagtttgctaaagcttttggtcaccatgttaccataatttctacatctccgtcgaaagaaaaggaagccagggaaaagcttggagcggacgacttcatattatctactgatgcaaagcaaatgatgactaaaaaaaggtctttggatttcattttagatacggtttctgcaaagcacagtttgggaccattgctagagctcttaaaagtaaaaggtactcttgttatcgtcggtgcacctgaaaaacccatggatttgcccagttttccccttatatttggtaaaagggtggttaaaggttcgatgatcggatctattaaagaaacccaagacatgatggatgtatgtggaaaacataatatcacgtgcgatattgaagtcgtgaatacagataacattaacgaggctctagatagattggctaaaaacgatgtaaagtacagattcgttatcgatattaccgcgaaatcgacccctaagcgttctgaggaaaggagagttggaaaggagtgtaggtctaggtggagtccatatcat

SEQ ID NO: 1351 - DNA, 624 bp, Nepeta cataria
atggccgaatttcaacagaaggcctttggattggccgccaaagattcttctggcgtgttatctccgtttcatttttctaggagagataatggtgctgacgatgtgaccataaaaatattatattgtggcgtgtgccactctgacttacacacagttaagaatgaatggggctttacacaatacccagtcgtaccaggtcatgagatctctggtctggtcacaaagattggtaacaacgtcgagaagttcaaggttggtgacagagtaggcgtaggtgttattgttggttcctgtcgtacttgtgatctgtgccagcaggatttagaaagctactgtccaaaaatgatattcacttataatgcaactgacaaagatggtaccagaacctatggagggtattcggacattatcgtggttgatcagcactttgtaattaggtttcctgacaatgtaccatctgatgcaggcgcccctttattatgcgcggggattacagtatattctccaatgaaatattacggaatgactgaagccggtaagcatctgggtgtggccggtttgggtggcctcggtcatgtagcggtcaaattcggtaaagctttcggagacagaaagagtgtagtt

SEQ ID NO: 1352 - DNA, 1065 bp, Nepeta cataria
atggcgaaatcagttaacgctgtgggatgggcagctagggatacttctggtcttctatccccgttaaaattcgctagacctgcagctggcgacagagatgtgcaatttaaggttttgtactgcggtatatgtcattctgaccttcactcaataaagaacgaatggggaaatacacagtatcctatcgttccaggtcatgaaattgtcggcgtggttacggcggtaggtcctaaagctacgaagtttaaggccggcgataaagtaggggttggttgtctcgttaactcttgtagacattgtgatcaatgtgctgctgatctcgaaaactactgtccacagttagttcaaacctataattccgtattagctgatggtagcgtcacgtacgggggttactctgatgttatgaccgcagacgaagactttgtaatcagatggcctgagaattttcctatggataaaggtgctcccctattatgcgcaggtgtgactacctattcacctctgagatattacggactagataaaccaggcctgcacataggtgtggtcggcttaggcggattaggccacgtggcagtaaagtttgcaaaagctttcgggactaaagtaactgtcatatcgacttcggccgggaagaaaaaagaagcaatagaaacgttgggggcagatgcattcttgatctctaaagatgctagtgaaatgcaggctgccgccggtactttagatgggatgattgatactgtttctgctcagcatcctctgccgccattattgtctcttctcaaaccccatgggaaattgattctagtcggcgcgccagataaaccacttgagttaccggctttccctttaataatgggacgtaagatggtagctggttctatcataggtgggatgaaagaaacgcaagagatgatagactttgcagcaaagcacaacattctaccagatgtagaaatgattcccatggattatgtaaatacagccatggagaggcttgctaaggcggacgtcaaatatcgatttgttattgatgtgggaaataccttgactaaggcagat

SEQ ID NO: 1353 - DNA, 894 bp, Nepeta cataria
atgtatccagtcgttccggggcatgaaattacaggcataattacaaaggtggggtcgaatgttactggtttcaaggttggtgacagagcgggcgttgggtgtttggctgctacctgtctaaagtgcgaatgttgtcaagaagggcaagagaattattgtgatgatgttcaatttgtatataatggtattttttgggatggtagcataacttacggcggttattctgattttttggttgccgatcacaggtatgttgtgagagtaccggaaaacttaccaatggatgccgccgctcctttgttgtgtgcgggcattactgtgtacgcccctatgaaggacaacaatctactagaaacaaaggggaaacacgtaggtgtggttggattaggtggtttgggtcacattgcagttaaatttgcaaaagcctttggacatcacgtaactattattagtacttcgccaagcaaggaaaaggaagcacgggagaaacttggagctgatgactttatcttgtccactgacgctaaacaaatgatgacgaaaaaacggtcgttagatttcatcttagatactgtctctgccaaacactcattgggcccgttattagaattactgaaagtcaagggtacgcttgttattgtgggggctcctgaaaagcccatggatctgccttcgtttccattaatctttggtaagagagttgtgaaaggatccatgataggttcaattaaagaaacgcaggatatgatggatgtatgcggtaagcataatatcacgtgcgacattgaagtcgtcaatacggataacataaatgaagccttacatcgtttagctaagaacgacgtaaaatacaggtttgtcattgatattgcggccaaatcgtctccaaatata

SEQ ID NO: 1354 - DNA, 1065 bp, Nepeta cataria
atggcaaagagtgttaatgctgtaggttgggctgctcgggacacatcgggtttattgtcgccattaaaattcgctcggcctgctgcaggtgatcgtgacgtgcagtttaaagttctatattgtggtatctgtcactccgatctgcattcgatcaaaaacgaatggggaaacacacaatacccaattgtaccaggtcacgagatcgtaggagttgtgacagcagtcggtccgaaagccaccaaatttaaagcgggagataaggtaggggtgggctgcttagttaattcttgcagacactgcgatcagtgcgcggccgatttggaaaactactgcccgcagttggtgcaaacctacaattcagtcctggctgatggtagtgtaacttatggtggatattctgatgttatgaccgccgacgaagatttcgttattaggtggccagaaaattttccgatggataaaggtgctccgttattatgtgccggggttaccacctatagcccattaaggtattatggcttagataaaccgggtctacatattggagttgttgggctaggcgggctagggcacgttgcagttaagtttgcaaaggctttcggcatgaaagtgactgtcatttctacatccgcagggaaaaaaaaagaagcaatagagacactaggggcagatgcttttctaatttctagggatgcatctgaaatgcaagcagctgccggcactttagatggtatgatagatacggtatcagcccaacatcccttaccaccactgctatctctactgaagccgcatggtaaattaattttggtaggcgcccctgaaaagccatttgaattgccggctttccccttgttaatgggtcgtaagactgtggcggggagtgttattgggggtcttaaagagactcaagaaatgatcgacttcgctgccaagcataatttactcccagaagtggaaatgattccaatggattatgttaataccgccatggagagattggcgaaagcagatgtcaaatacaggtttgttattgatgtggggaacacattgacaaaagctgac

SEQ ID NO: 1355 - DNA, 1065 bp, Nepeta cataria
atggccaaatctgtcaatgcagttggttgggctgccagagatacaagcggcttattgtctccgcttaaatttgctcgtcccgctgcaggtgatagggacgttcaatttaaagtactctactgtggaatttgtcacagcgacttgcattcaataaaaaatgagtggggtaacacacaataccctattgtccctggtcatgaaatcgttggtgttgtcactgccgtaggtccaaaagcaacaaaatttaaggctggtgataaggttggtgttggctgtttggttaattcatgtcgacattgcgaccaatgtgcagctgacttagaaaattactgtccacaactggtgcaaacttataattctgtactggccgatggttctgtaacatatggaggttattccgacgtgatgacagcggacgaagacttcgtgataaggtggcctgaaaattttcctatggataagggggctccgttgctatgtgctggtgttacaacgtatagcccattaagatactacggactagataagccaggcctccacataggtgtagttgggttgggtggattagggcatgtcgctgtcaaatttgcaaaggcattcggcacaaaggttaccgttattagcacgagtgcaggaaagaaaaaggaggcaattgaaacgttaggagctgatgcttttttaatatccaaggacgcgtcagaaatgcaagctgctgcggggactcttgacgggatgatagacacagtgtctgcacagcacccgttacctcctttattatcattattaaaaccacacggaaagctaattctagtaggtgccccagaaaaacccctagaattacctgcatttcctcttttaatggggagaaaaatggtcgcagggtccattataggtggtataaaagaaactcaagaaatgatagattttgcggctaaacacaatattttgcccgacgttgagatgatacccatggactacgtcaatacggcaatggagagattggccaaagcagatgtcaaatataggtttgtgattgacgttggcaacacattgacgaaagcagac

SEQ ID NO: 1356 - DNA, 1065 bp, Nepeta cataria
atggcggagtttcaacaaaaagcatttggtctggctgccaaagattccagcggggttctaagcccgtttcacttttcaagacgggacaacggtgcagacgacgtgactattaaaatattgtattgcggcgtatgtcactctgatctacatacggtaaaaaatgaatggggatttacacaatacccagttgtgccaggtcatgagattagcggtttggtgacaaaaattggcaataatgtcgaaaaatttaaggttggagatcgtgtaggggtcggagtaatcgtaggtagttgccgcacttgtgatctttgtcaacaggatctggaatcgtattgcccaaagatgatatttacttataatgctacagataaggatggcacgcgaacttatggtggatacagcgatataatagtggtggaccaacatttcgttataagatttcccgacaatgtaccaagcgacgccggtgctcccttgctttgtgcaggtattacagtatactccccaatgaaatattatggtatgacggaggcaggtaagcatttaggtgtggcagggttaggtggtctcggacacgtcgctgtaaaattcggaaaagcatttgggatgaaagttactgtcattagcacatcgccgaagaaaaagatagaagctataaataagcttggtgctgacgcatttgtagtctctaccgacgcggaacaattaaaagcagctaccggaacgatggactttattattgataccattgccgccgttcatcagctaacccctcttctgtctctgctgaaaatgaatggtaagttaatcactgtaggtctcccaaataaaccgcttgacttgcctatttttccactagttgctggtagaaaattaatcgggggtagtgatttcggcggtgttaaggaaacacaagaaatgcttgatttctgtggaaagcatggtatcactgctgacattgagctaatcggcatagaagatgttaacacggccatggagagactagctaaaagcgacgtgaggtatagattcgtgatagatgttggtaaatcaattgctaatctt

SEQ ID NO: 1357 - DNA, 513 bp, Nepeta cataria
atgtatcctgtggtacctgggcacgaaattaccggtattattacgaaagttggatctaatgttacagggtttaaggttggtgatagagccggagttggatgcctggccgcgacgtgtttgaaatgcgagtgttgccaggaaggacaagaaaattactgtgatgacgtgcaattcgtctacaatggtatcttttgggatggatctatcacgtacgggggatattccgattttctagttgcagatcatagatatgttgttagagtccctgagaatttgcctatggacgccgctgccccactgttgtgtgcaggtattactgtctatgcaccaatgaaagataacaacttgctggaaacaaaaggtaagcacgttggcgtcgtggggctaggcggattgggtcacattgctgtaaagtttgcaaaggcattcggacatcatgttactatcatatcaaccagtcctagtaaagaaaaggaagccagagaaaagttgggggatagaaagtctgttgtt

SEQ ID NO: 1358 - DNA, 1059 bp, Nepeta cataria
atgaccactgcaaatggcgaatgcattggatgggcagctagagatccatgtggtaccctctctccatatagattctcgagaaggtctgtgggggccgatgacgtttatatctcgattatgtactgtggcgtgtgttacgccgatgttatatggactagaaatgtgatgggacactctaactatcctttggtacctggacatgaaatcgtcggtattgtcaaggaggttggttccaatgtcgatcgtttcaaggttggagaacatattggtgttgggacttatgtaaattcctgccgtgagtgtgaatactgcgataaccagatcgaagttcattgttccaagggttcaatcttgacatttgatggcgtggactttgacggtaccatcaccaaaggtggatatagtagctacatagtagttcaccagagatattgcttcgtaattcctgaaaattacccgccccagttagctgctcccctcttgtgtgcaggtatcacagtttacaccccgatgatgagaaataacatgaatcaaccaggcaagtctttgggagttattggattgggtggtttagggcacctggctgtcaaattcggtaaggccttcggtttaaaagttacagtcttttccacttctatttcaaagaaggacgaggctttaaacttgttaggagctgataatttcgttttgagttcagatgaaaaggaaatgaaagcactcaagggaagcattgatttcataattaacactgcctcaggcgatattagttttgatctttatctatccctactgaagacaatgggagtttttgtcttagtgggctttccctcagaagtcaaatttttaccaggttcgttaaacctaggagccaagaccgtgacaggctccatcacaggtggaacaaagcagacacaagaaatgctggcattctgtgcttcgcacaaaatttatcctgaaatagaattaattcctattcactactgtaacgaggctttggagcgtttagttaaaaaagatgtgaagtatcgttttgttattgacattgccaattctctggcc

SEQ ID NO: 1359 - DNA, 942 bp, Nepeta cataria
atgtactgcggagtgtgttacgctgatgttatttggactcgaaacgttatgggccatagtaattatccgttagttccaggccatgaaattgtcgggatcgtcaaggaagtaggttcaaacgtagataggttcaaggtgggtgagcatatcggagtgggaacatatgttaattcgtgtagggaatgcgagtattgtgataaccaaatagaagtgcattgcagtaaaggcagtatcttgacttttgatggtgtggactttgacggtacaattactaaaggtggttactcctcatatattgtcgtgcatcaaagatattgttttgtgattccggaaaattatcctcctcaattggctgcccctttgctttgtgccggaattacagtttacactccaatgatgagaaataatatgaatcaacctggtaagtcattgggagtgatcggtttaggtggtttgggacatctagccgtaaaattcggtaaggctttcggtctaaaggtaactgttttttccacaagtatatctaagaaggacgaggcactaaacttgcttggtgctgataatttcgtattgtccagtgatgaaaaggagatgaaggctttaaaaggaagcatagactttataatcaatacagcctctggggatatctcttttgacctgtacttatcccttttgaagactatgggagtttttgttttagttggttttccttcagaggtaaagtttttacctggctccctgaacttgggagccaaaacggtgacaggttcaattaccggtggtacaaaacaaacacaagaaatgttagctttttgtgcaagtcataaaatttatcctgaaatagaactaataccaatccattattgcaacgaagcattggaacgcttagtcaaaaaagacgtgaagtacagatttgtgattgatattgctaatagtctagca

SEQ ID NO: 1360 - DNA, 681 bp, Nepeta cataria
atgtatccagtagtacccggccacgaaattacaggtattatcaccaaagttggatctaatgtaactggttttaaagtaggagacagagccggagttggctgcctggctgctacctgtttgaaatgcgaatgttgtcaagaaggacaggagaactactgtgatgatgtccagttcgtttataatggtatcttttgggatggttctattacctatggcggttattctgactttctagtagctgatcatagatacgtagtacgcgtcccagaaaatttaccaatggatgccgccgcaccattgttgtgtgctggaattactgtatatgcgcctatgaaagacaataatttgctagaaactaagggaaaacacgttgggattgtaggtctgggtggattaggtcacatagccgtgaaattcgcgaaggcttttggccatcacgttactattatttcgacatccccatctaaagagaacgaagcacgtgaaaagttgggtgcagacgattttatcctgtctacagatgcaaaacaaatgatgactaaaaagaggtcattggatttcattctggatacggtttcagcaaaacattcgttaggccctctattggaattgctgaaagtcaaacgtagtgaagaaagacgtgtcggtaaagaatgtcgctcccgatggagtccttaccat

SEQ ID NO: 1361 - DNA, 792 bp, Nepeta cataria
atgtatccagtggttcccggtcatgaaattacaggtataataacaaaagtaggctctaatgtaacaggcttcaaagttggtgatagggccggtgtaggctgtctagcagcaacatgtttaaaatgtgaatgctgccaggaaggccaagaaaactattgtgatgacgtacaatttgtttataacggcattttttgggacgggtcaatcacttatggaggttactcagattttcttgtggctgaccatagatatgttgttagagtccccgagaacttacccatggatgctgcagctccattgttgtgtgctggaatcacagtttatgctccaatgaaagataacaatttgctggaaacgaaagggaagcatgttggcgtagtcggtctgggtggcttgggtcacattgcagtcaaatttgcaaaagcctttggccatcatgttactatcatttcaacaagtccgagcaaagaaaaagaagcaagagaaaaacttggagctgatgattttatcttatcgacggatgctaaacaaatgatgactaaaaaaagatccttagatttcatactggataccgtctctgccaagcattcgttgggtcctctattggagctattgaaagttaagggaaccctggttatcgtaggcgcacctgaaaaacctatggacttgccatcttttccactgatattcggtaagcgggttgtcaagggctcaatgattgggtcaatcaaagaacgatctgaagaaagaagagttggtaaggaatgtagatccagatggtccccatatcac

SEQ ID NO: 1362 - DNA, 1122 bp, Nepeta cataria
atgtcggcaatccgttgtaaggcggcagttgcgtgggcagccggcgaacctttggtcattgaggaggttgaattgagccctcctcagcccatggaaataagaataaaagtggtatgtacaagtctgtgcagatccgatcttacagcatggctgtcacaggctcaaccccagttatttccgagaatttttggccatgaagccagcggagtagtcgaatcagttggtgagggagtaaccgaattcgaagtgggcgatcacgtgttgactttgtttacaggagaatgtatgaagtgcaagccatgtgcctctggtaagtctaatacctgccatacattgggtctcgaaagacaaggtgttatgcactcggacaaaaaaactagatttagcattaagggcaaacacgtatatcattactgcgcggtttcatcattttccgaatacacggtggttcactcaggatgtgcggttaagatttccccaatcgctcctttagaaaagatttgtttgttatcttgtggcgtcgcggcgggtctgggggctgcttggaaagtggctaatattagcgagggttcaactgtagcaattttcggtcttggaacagtaggattgtctgtcgctcaaggcgctaaaagacgcggagcttctcgcatcattggtattgatacaaaccctaaaaagagtgaaaccgcaaaagcttttggcgtcacggacttcgtcaatccaaatgatcatgatcaaccaatccaacaggttataatcggaattacagatggtggtgctgactacgcctttgaatgcgttggtgatacaggtatgataaccgccgctcttcaaagttgttgcgcggggtggggcttaactgttactcttggtgtgcccaaggaagaaccaggtataactgctcattatggtttgttcttgtctggacgcactctaactggttctctctttggtgggtggaaacccaaatccgatttgcctagtctagttgacatgtatttaaaaaaggaaatcgagatcgacaagtatataactcataacttgatgtttgaagacataaacgaagcttttgaactaatgggtaagggtaaatgcttgcgctgtgtgatacacatgccgaaa

SEQ ID NO: 1363 - DNA, 1131 bp, Nepeta cataria
atgggctccttgggtagcaacaatcactccgaccatatttttatctccaatgaaacaattggcaaggtaattacttgtaaggctgcagtcgcttacgctgctggtgaacctttagtagttgaagaaattagagtagaccctcctcaaaagatggaggttcgtattagagtcctgttcacttcaatctgtcatacggatttatccgcatggaaaggtgaaaccgaagctcatcgcgtttacccgagaatctttggccacgaggcttcgggcgttgttgaatccgtaggtgagggagtctcggacatagaaattggtgatcatatcgttcctatttttaacggcgaatgtcaaaattgtgtttactgcaaatctaaaaaaaccaatctgtgccagaagtacagggtaaatccgatgaagtccactatgacaggggatggtaaatgcagattcagcaccaaagaaggcaaccccatattccatttccttaatacctccacattttccgaatatacagtactggattcagcctgtgtggttaagatcgatagaaaagcctctttagagaagatgactctattgtcttgtggagtgagcactggtttaggagctgtttggaacaccgccgatgtagaagaaggatcgaccgttgcagtctttggattgggtgccgtgggtctggcagttgtggagggagctagagcacgtggagcctcaagaattattggagttgatattaactccgataaacaaataaagggcagagccattggtttaactgattttattaatccgaaggatctagatattcctgtacatcagaaaattcgagagatggctaatggtggtgttgactactcattcgaaagtgcgggcaatttagacgtgttaagagaggcctacctatctactcacgatggctggggttttactgtcattttgggtatacatcctacacccaggatgctgccgctccacccaatggaactttttgatggtagacgcattgtagcatctgtgttcggtgattttaagggaaaatctcagctaccacactttgccaaccaatgtatcaagggggaagttaaattggacgaattcattacacacgaaatcgatagaaagagcgttgtt

SEQ ID NO: 1364 - DNA, 729 bp, Nepeta cataria
atgtctgctattcgttgcaaagctgcagttgcttgggctgctggggaaccgttggtgatcgaagaagttgaactatccccaccacaacctatggaaattagaattaaagtcgtgtgcactagcctatgtcggagtgatttgacagcctggttgtcacaagcccagccacagcttttccctagaatttttgggcatgaggccagcggagttgttgagagtgttggtgagggtgtcaccgagttcgaggttggggatcatgtattaacattgtttaccggtgagtgtatgaagtgcaagccatgcgcgtcaggaaaatcaaatacatgccatactctagggcttgaaagacaaggtgtcatgcacagtgacaaaaagacccgtttctctattaaaggtaaacacgtgtatcattattgcgctgtatcttctttcagtgagtacaccgttgtccacagcggttgcgctgttaaaattagtcctattgctcccttggagaaaatctgtctgttgtcatgtggcgtcgctgctggtttaggagccgcatggaaagtggctaacatttcagaggggtcgactgttgctatctttggcttaggtaccgtaggattatctgtcgctcaaggagccaaaagacgtggggcatctagaatcattggaattgataccaaccatagatctgaagaaagaagagtaggtaaagaatgtaggagcaggtggtccccctatcat

SEQ ID NO: 1365 - DNA, 534 bp, Nepeta cataria
atgtctgccattaggtgcaaggcggctgttgcatgggccgcgggtgaacctttagttatcgaagaggtggaactttctcctccacaacctatggagattagaattaaagtcgtttgtacatccctatgcagatcggatttgacggcctggttgtcgcaagctcaacctcaattgttcccgagaattttcggacacgaagcgtccggtgtggttgaatcggtaggtgaaggggtcactgaatttgaagtgggcgaccatgtcttgacgttgtttaccggcgaatgtatgaaatgtaagccttgtgcaagtggaaaatctaatacctgccatacactaggtcttgaacgtcaaggggtcatgcatagtgataagaaaacacggttttcgattaaaggaaagcatgtctatcattactgtgctgtttctagttttagtgaatatacggttgttcactcagggtgtgccgttaagatatctccaatagcacctttggagaagatctgtttgttgtcctgcggcgttgctgccggcaca

SEQ ID NO: 1366 - DNA, 1305 bp, Nepeta cataria
atggccttttgcagatcttcattactactacgaaaagctctaggcggttcaagaagagctgctgctgctgccacatgttcaagtgcttatgcatgcgggtggcaatcagaacgtggcaggtggtacagcggaggagaagggactactatatccgctccgggctaccacgtaaatacagcaccatcccatatgaccggtgctgtcttttgggataaggataaaccaattacttacgaagaatttgagatgccaagacctaaagctaatgaggtgttaattaaaacaaaagcctgcggggcatgccattcagatttacatgtaattaaaggtgatcttaaatttccttgtccatgtatactaggtcacgagattactggcgaagtagtcgaacatggtcctctgaccgaaactaaatatattgaaagatacccagtggggtctaaagttataggtgctttcattatgccgtgcggtagttgtttctattgtagccgtggtgaagatgatttgtgtgaaccatattttgcatataatcgtgccaaaggtacactatatgatggacaaactagattgttccttcgtgggtcaggtaagccagttcatatgtggagcatgagtggcctggctgagtattgtgttacgccagtaaatggcctgggtgcgttgcccgataccttaccttacgctgaaagttcagttcttggttgtgccgttttcaccgcatatggcgctattgcccacgctgctgaggtaaaacctgggaatagtgttgcagttattggaattggaggtgtgggttcttcctgtttacagattgccaaagctttcggtgcttctgaaataatcgctgttgatgtagaggacggtaaattagaaaccgcgaaaacttttggcgcaacacacatcataaattctagaaaagaagatgctattgctaagattaaagaactaactgatggtagaggtgttgatattgcagttgaagctataggtggtcccaaaacctttgcccaatgtgtgggctcggttagagcgggcggaaaggcagtgatgattggtttgtcccctactggaggaaaaggcgaggtcgaaataactcaattggtccgcagaaaagtgaaagtcataggttcctatgggggtagagctatgacagacttgccaaaattagttgaactggcagaacagggaacatttaatctggaggccgcagttactagaagatataaatttgaagaagtcgcacaagcttatcaggacttacaaaacaaaacaattgttggcagaggcgtgatcgaaatcatg

SEQ ID NO: 1367 - DNA, 666 bp, Nepeta cataria
atggttgtgcaccaccattttattgtccgtataccagataacatgcctttggacgcagccgcgccgctcttatgtgcgggtattacgacttactcgcctctcagatactttggtttggataaacctggtcttcacataggagttgtcggcctcggtggcttgggccatttggctgttaaatttgcgaaagctttcggcgctaaggttacagtcatctctacatctcctaataagaaagaccaagctttgtctcatctaggtgcggactcatttttaatctcaaaaaatgcttgcgaaatgaaaggcgccatgggtacaatggatggaatattagatacggtctcagccgtccaccccgttatggagttggtaggtctactaaaagcacagggtaaattgataatgttgggcgctccggaaaaacctttggaacttacggcctttccactaattgcaggcagaaaaatgatcgctggttctggtattggtggaatgaaagaaacacaagaaatgattgattttgccgcaaaacacaacattaaggctgatattgaacttataccaatggactacgttaatactgcgatggatcgtttggcaaaagctgatgttaagtatcgctttgttattgacgttgccaacactatcaaaaattctttgttatta

SEQ ID NO: 1368 - DNA, 1137 bp, Nepeta cataria
atggcccaagccacgccaaaccacactcaaaccgtttcaggctgggctgctcacgatacaagtggaaaaattactccatacacctttaagcgaagagaaaatggagaagatgatgttaccataaagatattgtattgtggcatctgtcacactgacttgcattttgcaaaaaacgaatggggaattactatgtacccagttgttcccggtcacgaaataaccggcattatcactaaggtaggaagcaacgttactggtttcaaagttggtgacagagcaggggtaggctgcctggcagctacttgtttgaaatgcgaatgttgccaagaaggtcaagaaaattattgtgatgatgtgcaattcgtgtataatggaatattctgggacggcagcataacttatggtggttactcggacttcctggttgctgatcatagatacgtagtgagagttccagaaaatctacccatggatgctgcagctccgcttttatgtgcaggtataaccgtttacgcccctatgaaggataataatttgttggagaccaaaggtaagcacgtaggcgtcgtaggtcttggaggtctaggtcacattgctgtcaaattcgcgaaagcgttcgggcatcacgttacaataatcagtacttctccaagcaaggagaaggaagccagagaaaaattgggtgccgatgatttcatcttgagcaccgatgcaaagcaaatgatgactaagaaacgatctctagatttcatactagataccgtttccgcaaagcattctttagggccactattggagttgcttaaggttaagggaacactcgtcatagtgggcgcacctgaaaagcctatggatttaccgagtttccctttaatttttgggaagagagtagttaaaggttccatgattgggagtatcaaggagactcaggatatgatggatgtttgcggtaaacataatatcacatgtgacatcgaggtcgttaatacagacaatataaacgaagcattggatagacttgctaaaaatgatgtcaaatatagattcgtaatagatattacagcgaagagtacccctaagcggagcgaagaaagaagggtgggtaaagaatgccgctctaggtggtcgccataccat

SEQ ID NO: 1369 - DNA, 1083 bp, Nepeta cataria
atggctcaagcaactcccaatcatacacagactgtttcaggttgggctgcgcacgacacctcgggaaagattactccatacacattcaagagaagagagaatggtgaagacgatgtaaccataaagatattgtattgtggaatttgtcacacagacttgcattttgccaaaaacgaatggggcattactatgtatcccgtagtgccaggccatgaaattactggtatcatcacaaaggtaggttcaaacgtaacgggctttaaagttggcgatagggccggtgttggatgcttagcagccacatgtttaaagtgtgaatgttgccaagaaggacaagaaaattattgtgatgatgtacaattcgtgtataatggtatcttttgggacgggagtattacttacggtggttattcggattttctagtggcagatcataggtacgtcgtcagagtacccgaaaacctgccaatggatgctgctgctccactcttatgcgctggtataacagtatatgccccaatgaaggataacaatttgttggaaactaagggcaaacacgttggagtagttggtctaggtggactgggacacattgcagtaaagttcgctaaggcattcggacaccatgttactatcattagtacttcaccctccaaagaaaaggaagctagggaaaaactcggtgctgatgactttatcctgagcaccgacgcaaaacaaatgatgacaaaaaagagatcgttggattttatcctagatacagtaagcgcaaaacattctctgggtcccttgctggaactactcaaagtgaagggaacgttggtgatagttggcgctcctgaaaagcctatggatctaccttcttttcctttaatttttggtaagcgggtagtcaaaggatccatgatcggttccatcaaagaaactcaagacatgatggacgtgtgtggtaaacataacattacatgcgacatagaagtggtaaatacggataatataaatgaggctttgcatagacttgccaaaaatgacgttaaatatagatttgtgattgacattgctgctaaatcgtcccctaacatt

SEQ ID NO: 1370 - DNA, 894 bp, Nepeta cataria
atgtatccagttgttcccggccatgaaatcacgggtatcattacaaaagttggttctaatgtaacgggtttcaaagttggagatagggcaggtgtcggatgccttgctgctacttgtttaaagtgtgaatgttgtcaagagggtcaggaaaattattgcgatgatgttcaatttgtttataacggcatattctgggatgggtctataacttatggcggttattctgactttctggttgctgatcacagatacgtagtgcgcgttcctgaaaatttaccgatggacgctgcggcacccctattatgcgccggtataaccgtttatgcccctatgaaagacaataatcttttagaaacaaaaggtaaacatgtgggcgttgttggcctaggtggtctgggtcacattgcggttaaatttgcaaaggcatttggccaccatgttacgattatatctactagcccctctaaagaaaaagaagctagagaaaaactaggtgcagacgattttattctgagtacagatgctaagcaaatgatgacaaaaaagaggtctttagacttcatattagacactgtatctgccaaacattctttgggccctttgcttgagttactcaaagtgaaaggcaccttagtaattgtgggggccccagaaaaaccaatggatttgccaagtttcccgctaattttcgggaaacgagtggtaaagggttcaatgatcgggtccattaaagaaacccaggacatgatggatgtctgtggtaaacataacattacgtgtgatatagaagtggtaaatacagacaacattaatgaggctctagatagattagcaaaaaatgacgttaaatatcgttttgtcattgatattactgctaaaagtactccgaaaata

SEQ ID NO: 1371 - DNA, 702 bp, Nepeta cataria
atggcgcaggcgactccaaatcatactcaaactgtgtcaggttgggccgcacacgatacatccggcaagattactccttacacgtttaaacggcgtgaaaatggtgaagacgatgtgactataaaaattttgtattgtggtatttgtcatacggacctacattttgctaagaacgagtggggtattacgatgtatccggtcgtccccggccatgaaatcacaggaataattacgaaagtaggttctaatgtgacaggcttcaaagtcggggatagagctggtgtcggctgtttagctgcaacctgtttaaaatgtgagtgttgtcaggaagggcaggaaaattactgcgacgacgtccaattcgtgtacaacggtattttctgggatggctcaataacttacgggggttatagcgactttttagtggctgatcatcgatatgttgttagggtaccagagaatctacccatggatgctgctgctccattattgtgtgctggaatcactgtatacgctcccatgaaggacaataatttattggaaacaaaaggtaaacatgtcggtgtcgtcggtcttggtggcctgggtcacatagcagtaaaattcgctaaggctttcggccatcacgtaactattatttcaacttcaccatcgaaggaaaaagaggcaagagaaaagcttggtgatagaaagtctgttgtg

SEQ ID NO: 1372 - DNA, 942 bp, Nepeta cataria
atgtactgtggcgtttgttatgcagatgtgatctggaccagaaacgtaatgggtcattctaactacccacttgtgccaggtcatgagattgtaggtattgttaaggaagtcggttccaatgttgacaggtttaaagtaggtgaacatattggggtgggtacctacgttaacagttgtagggaatgtgaatattgtgacaaccagatagaagtgcactgttcgaaaggctcaatcttgacattcgatggcgttgactttgatggcactattaccaaaggtggctactcatcctatattgttgtacatcaaaggtactgctttgttattccagagaattatccaccccagctcgctgctccattactatgtgccggtatcacggtatatactccgatgatgcgtaacaatatgaatcaaccgggtaaatctttgggggtcattggattgggtggcttgggtcatctggcagttaagtttggtaaagcttttggtttgaaagtcactgtcttctctacatccatttctaaaaaacatgaagcattgaatttgcttggtgccgataattttgtactctccagtgacgagaaagaaatgaaagccttaaaaggttcaattgatttcatcattaacacagcatcaggtgatatctcattcgacctatatctttctttacttaagaccatgggtgtatttgttctagtaggatttccgtcggaggttaaatttttacctggctcgcttaacttgggcagtaagactgtgactggaagtatcaccgggggtacaaaacagactcaggaaatgttggcgttctgtgctagtcataagatttacccagagattgaactaatcccaatacattattgtaacgaagccttggaaagacttgtcaagaaggacgtcaaatataggtttgttatcgacattgccaactcattagcc

SEQ ID NO: 1373 - DNA, 981 bp, Nepeta cataria
atggcacaagctactccaaatcacacacaaaccgtgtcgggttgggcagcacatgatacctctggtaagattacaccctacacattcaaacggcgtgaaaacggtgaagacgatgttaccatcaagattttatactgcggtatctgtcacactgatctccatttcgccaaaaacgaatgggggattactatgtatcctgttgttccaggtcatgaaataacaggtataatcaccaaagttggtagtaacgtgacaggatttaaagtcggtgatagagcaggtgtcggttgccttgctgctacttgcttgaagtgtgagtgctgtcaagaaggtcaagaaaattattgcgacgatgttcaattcgtttacaatggaattttctgggacgggtcgataacatatggggggtatagtgattttttagttgcagatcataggtacgtcgttcgtgtgcctgaaaaccttcctatggatgccgcggctcctctgctatgtgcgggaatcacagtgtacgcacctatgaaggacaataacttactggagacgaaaggtaagcacgttggagttgtaggattgggtggattaggtcatatagcggttaagttcgctaaagccttcggacatcacgtgactatcatatctacatcaccgtctaaagaaaaggaagccagggaaaagttaggtgcagatgattttattctttcaaccgatgctaaacaaatgatgacaaagaagagatcacttgatttcatcttggacactgtttcagcaaaacactccctcggtccactattagaattgcttaaagtgaagggcaccctcgtcattgttggggcaccggagaaacccatggatcttccttcctttccgctaatatttggcaagagagtggtgaaaggtagtatgataggtagtattaaagaacggtctgaagaaagaagagtcggtaaagaatgtcgatcaagatggagcccgtaccat

SEQ ID NO: 1374 - DNA, 1137 bp, Nepeta cataria
atggcaactcacggtcaagttatcacatgcaaagctgctgtagcttgggagcctaacaaacctcttgttatcgaagaggtccaagttgctccaccacaggcaggagaggttaggatccaaatcttatttacagcattatgtcacaccgatgcatatacatggtctggtaaggaccccgaaggattattcccatgcatccttggtcatgaagctgcgggcattgtcgaatccgtgggggagggtgtaactgaggtgcaattaggggatcatgttataccctgctatcaagccgaatgttctgaatgtaagttctgtaaatctggaaaaactaatctttgtggaaaagtgcgtgtcgcaactggagtgggggttatgatgactgatagaaaatcacgtttctcagttaatggtaaaccaatctatcattttatgggtacatcaactttttcacaatacaccgttgttcatgatgttagcgttgcaaaaattgatcctgttgcacctttggaaaaggtttgcttacttgggtgcggtgttcctacaggtctgggtgctgtttggaacactgctaaagttgagcctggaagtatcgtcgcgattttcggattaggaacagtaggacttgcggtggcagaaggtgcaaaggctgcaggtgctagcagagttattggtatcgacattgatgctaaaaaatttgacagagctaaggatttcggtgttacagaatgcataaaccctaaagatcatgaaaaaccaatacaacaggttattgttgatctaactgacggtggtgttgattactcttttgaatgtataggtaacgtcagcgttatgagatccgctctcgaatgctgtcataaaggatggggcacctccgttatcgttggtgtagctgcctcgggtcaggaaatttcaacgagaccatttcagttagtcaccggtagagtatggaaaggcaccgctttcgggggctttaaaagtcgttcccaagtaccatggttagttgacaaatatttgaagaaagaaattaaggtcgatgaatacattactcataattctactcttgccgaaatcaacaaggcgtttgatatgatgcacgagggaatgtgtttgagagtcgtattagacatgaacatg

SEQ ID NO: 1375 - DNA, 702 bp, Nepeta cataria
atgtattccatggggggcttggctgaattctgcgttgtgccagcacatggtttaactagtttaccaaacaccttaccgtataccgaatcggccgtgttaggatgtgctgttttcaccgcatacggtgcgatggcacacgcagcacaagttagacctggagattcggttgctgttattggcatagggggtgttggcagttcttgcctacaaatcgccaaggcctttggtgccagtgaaatcatagcagtagacgtgcaagacgaaaagttggaaaaggctaaaatactaggggctacacacgcaattaattctaggaaagaagatgctgtagcaaaaattaaagagattactggaggtaggggtgtagatgtcgcagtcgaagcattgggtagacctcaaacattttcccagtgcgtccaatgtgttcaagacgggggtaaagcggtgatgataggtttaaccttgagtggggcaaaaggcgaggtggatattaaccatttggtcaggcgtcaaatcaaagtcatcggttcgtatggtggcagggctagacaggatttaccaaagttagttaaactggctgagaaagggacattcaatctccaggcagctgtttcaagaaagtataaattcgaagaagttgaagaagcatacaagaatcttgatcaaggatccattgtgggtaggggagtcgtcgaaattatg

SEQ ID NO: 1376 - DNA, 513 bp, Nepeta cataria; identical to SEQ ID NO: 1357

SEQ ID NO: 1377 - DNA, 624 bp, Nepeta cataria
atggctaagttccaacagaaagctttcggacttgcagcgaaagattcatctggtgttttgtcgccattccatttttcacgccgagataatggtgctaatgacgttactatcaaaactttgtattgcgggatttgtcactcggatttgcacacagttaaaaacgaatggggtttcacgcaatatccggtggtgccagggcacgaaatttctggcttggtgacaaaagttggcaataatgttgagaaatttaaagtaggcgatagggttggggtcggcgtgattgtcggatcctgtaggacctgtgatctgtgtcaacaagatctagaaagttactgtccaaagatgatctttacatataacgcaacggataaggatgggaccagaacctatggtggatattctgatattatcgtagttgatcaacattttgttataagattcccagataatgtcccgtctgacgcaggcgcgccgttattgtgtgccggtattacagtctactctcctatgaaatactacggaatgacagaagcaggtaaacacctcggtgttgcaggactaggaggattaggtcatgtcgctgtcaaattcggtaaagcgtttggcgataggaaatccgtagta

SEQ ID NO: 1378 - DNA, 1065 bp, Nepeta cataria
atggctaaattccagcaaaaagcttttggacttgccgctaaagattcctcaggtgtattgtcccccttccatttctctcgtcgtgataacggtgcaaacgatgtcacgataaagacgttatattgtggcatctgccatagcgatttgcacacagtaaaaaatgaatggggctttacgcagtatcctgtagttccaggtcatgaaataagcggattagtcactaaggttggtaacaatgtagaaaaatttaaagtaggagatcgagttggtgttggtgtcatcgtcggtagttgtaggacatgtgatctatgccagcaagatttagaatcgtactgcccaaaaatgatctttacctacaatgcaacagataaagatggtaccagaacctatggtggttacagcgacataatcgttgttgaccaacatttcgtcatcagatttccagataacgttccttcggacgctggtgcaccacttttgtgtgcaggtattacagtttactctcctatgaaatactacggaatgaccgaagccggtaagcatttgggagttgctggtttaggagggctaggtcatgtcgccgtcaaattcggtaaagcgtttggtatgaaagtgactgtgattagtacttctcctaaaaagaaaattgaagccattaataaattgggtgcagacgcattcgtcgttagtaccgatgctgaacagttaaaagcagccactggaacaatggatttcatcatcgacactatagcggctgttcatcagctgacgccattgttatcactattgaagatgaatggaaagttaattacggtggggttgcctaacaaaccattggatcttcccatcttcccattggtagccgggcgaaaattgattggtgggtctgatttcggaggtgtgaaggaaacacaagaaatgttggatttctgtggcaaacatggtataaccgctgatattgaattaataggcattgaggacgtcaatacagcaatggaacgtttagcaaaatcggatgttagatacaggttcgtgattgacgttggcaaaagtattgccaatctt

SEQ ID NO: 1379 - DNA, 957 bp, Nepeta cataria
atgtctagggagggagaaggaaaggtagtatgcgttacgggcgcttcagggtatgttgcttcttggctagttaagctgttactacagagaggctatactgtcagagctaccgttcgtaatctgagtgatccattgaaaactgaacatttaaaggccctagatggagcagccgagagattggaattattcgaagcagatctagttaaagagggttccttcgattctgttttccatggttgtgatggtgtctttcacaccgcttctcctgtaatctttaggaccactaatccacaggcagatcttatagaacccgccgtcaaaggtacagtgaatgttttaaggagttgcaccaaggcttcgtcagtccgccgggtggttctcacatcttccacagcagctgttgttgtgaatggccgtccttttggcccagatgtcgttgtcgacgaaacctggttctctgacccgcatttctgcgagaaaaataaagactggtattgtttatctaagactttagctgaggaggcagcttggaaatttgctaaggagaatggaatcgatctagtcgtaatgaacccagggcttgttttgggccccttgttgcaaccaaccttgaacattacgagtcaggtttttttggacattattaaaggtaaaccgatagcaccatactaccaatgcgttgacgttagagatctgggcgacgcccatattttgggtttcgaaaaatcctccgcctcgggaaggtacatactagtcggtaaaactatcacccatttgcagttcatgcaattgttgcataacttgtatccatccatcgttgacgctccaaccagtgtcgctgataatccaattggagaagtatccaagaaaaaggcagaatcattgggtatgtctttcatgccactggaagtgacagtcaaagattcagtggaatctttaaaagaaaagaacttctta

SEQ ID NO: 1380 - DNA, 972 bp, Nepeta cataria
atgaaaagagtctgcgtaactggtggaaccggcttcatagcttcatggttgataaaacgcttgttacatacgggttactcagttaacacaactgtacgaaagaatgctgatggtaaacgtgacctccgttacctaacaaatttacccggggctagtgaaaatcttaatatatttgatgcagacttggatcaacccgattccttcacgccagcgatcgaagggtgtgttggcgtgtttcatatagtccacccaatggaatgggacgaaaccgaatcagaagagacaaaaaccaagcgagttattggtggtcttttagccatccttaaagcatgcttagattcacctactgtgcgtaggtttatgcatacatcgtcttcctctgcagttgtttttgacggcaaagatcttgacactagagatgagacttcctggtcacatttggatcttatgagaaatatgggtctacagggaaactcgtatactatcacgaagacattggccgaaagaacggcattggagtttggaaaacaacatggattagatgttatttctctagttccttcgtgggtgcacggcccattctttacccctaggtgcccaaactcggtgctcgtgttcttagccctgatacttggtgatgaaaactattataagttcttgatgaaagcttctgttgtccatgtcgatgatgtggctcgcgcgtttgtgcacttatttgaatgccctgaggctgaaggccgttatatttgcagcgcattggaagtgacaatcgaagaattaagcgaatttttatctcaacgttacccacaatttcatatccctaccgccgactcgttcaaaggcatagagccggtgaagctttgtggtctatcgtctaagaaattgttagaaactggattcaagtatgaatatggtctggaggaaatgttcgatggtgcaattcatagttgcaaggaaaaaggcatattgtat

SEQ ID NO: 1381 - DNA, 999 bp, Nepeta cataria
atgggcgaagaaactaacatgaaaggcaaagtgtgtgtaaccggcggcactggttttttggggtcatggatggttaagcgtctgttacaacatggttacagtgttaacacaactactcgcattcaagctggagaaaagaaaaggaacatcgattacttacgtaatttagcgggcgcttctgaaagattgcatattttcgatgctgacctcgatagaccggaatcattctctgcagccattgaagggtgcgtcggtgtcttccatgtggcacatccattggactttgaagaaagagaaactgaagaggtaaaaattaaaagggtcgttaatggcaccgtcggcatattgcaggcctgtgtggatgcgaaaacagtcaagcgagtggtttactgctcctcggtagccacggcggtctttaatgacaaggccgctactttggacaaaatagatgaatcctcctggacggacgttgaattcttgcgtagtctaggagtctttggaggtgcatactcagtaacaaaaacgttagtcgagcaaaccgttttggagtttggtgaaagaaatgggttggacgttgttgccatacttccgtcatggatacatggcccctttatctccccttattgtccagattccgtgtctatatgcatggctttaatacaaggggacaagaaatcgtatcaacgcttagttagaacaagtctagttcatgttgatgatgtagtaagagcccatattcatctgtttgaataccctcaagccaagggtcgctacatctgttctaacgtggacataacaattgacaagttgcatgaatttctcaaagctaattatcctgaatataagcttccatccaccgaggaatttgaagacttaattccggtggctttccctgaactttcatccaaaaagttattagagactggatttaagttcgagaatggcttgcaggaaatgttcgacggggctattaagtcttgtaaaaaaatgggtctcctc

SEQ ID NO: 1382 - DNA, 957 bp, Nepeta cataria
atggccgaaaaaggtaaatgcgtctgtgttacaggtgcagggggttacgtcgcatcttggctgataaatttattgctttcccaaggctatacagttcatgctaccctaagaaatcccggagacgaaaaaaatggtcatttacataaattggaaaatgctccacaaaacttgaagttattcaaggcagatttgttagactttgactccatcttggctgcagtaaaagggtgtgatggcttgttccacgtggcttcgcccgcgcctcctgctagcgttccgaatccacaggttgaaatcgttgagcctgccgtaaagggtacattaaacgttcttaaagcttgtttcgaggcgagtgtgtgtagggtagtcatcgtttcttcgggtgttgccgtcttcatgaacccaaactggcctaaggataaagtcttagatgagagctgttggtcggatgctgaattttgtgctcgtacaaacaattggtattgttacagcaaaactgccgccgaagctgaagcatggtcttatgcagaaacgaacggcttagtattagtttctgtttgtccaactttggtcttggggcctatgttgcaacagacgcctaatagtagttctttaattctattaaaattgctcaaagaaggatatgaagttacagaagatcacgacagagtaattgtggatgtcagggatgtcgctgaggccatgaagctagtttacgaaaatagagaagcaaaaggacgctatatttgtacatcccatactattaaaactcgagacttagttcaaatgttaaagcaaatttacccaaattaccattaccctaaatccttcaaagagggtaaggaattgccacagcttagctctgggaagttagaaggtcttggttggaaatacaaaccgctagatgaaacattagttgatagcgtcgagaattataaacagataggtttgctgatg

SEQ ID NO: 1383 - DNA, 987 bp, Nepeta cataria
atggagaaatccgtgaaagtttgtgttaccggtggtgccggatacatcgcctcctttttgattaaacacctactattgaggggatacacagtacacgccacgttgagagatttgggtgatgactccaaggttggtttactaaaaagattagaccacgccgaaacacgactgaagttattcgccggagacatgtacaatccaactgaattcgcagatgcgatttacggttgtgaatttgtttttcatattgcaacaccaatgcagcatactgaaggtagtcaatataaaaatacatgtgaagccgctgtggccggtgccaaaatgatagctgagtcctgtattaaatctaggactgtgaaaaaattgatctataccgcaagtgtaacagctgcctctccattgaagggggacgctagtggatatgaggatgtcatggatgaaacatgctggactcctctaaaccattcctttcaattacattatgattatgttaacagcaagacattagcagaaaaagaagtcctatcctacaatggtgccgggatgggcgtagtttctttagcctgtggtcttgtaggcggggagactatacaaagtttcgcctccggtagcatggctgtcctcatctcacaagccacaaacgatggaacgttatataaagctctgagggaactggaagacctagatagtaaggtacctatagtacacttacaagatgtcatggaggcgcatatgtttgctatggaaaactcggatatgaatggtagatttctggttgcctcggattttcttaagagtgcccaaatagcttcgcttatacaaaaacattacccccatataaacatctcctcacaattgattgaagataccaagagggaaacaaagtggggctctagaaagttacaagatttaggatttgaatataagtgtgatgcagataagattatttacggttcaattgtgtgtgctaaaaaattcggccttata

SEQ ID NO: 1384 - DNA, 960 bp, Nepeta cataria
atggcagaaaaggacaagacagtatgtgtaacgggtgctggcggattcgttgcaagctggttagttaagttgctgctttctcaaggttatactgttcatgggacggttaggaacccgggagatgagaagaatgcccacttaaagagattagacaacgctgcagaaaatttgaaacttttcaaggcggacttgctagacttcggctcaatcatcgaggccgtcaaaggttgtgtcggggtgttccacgtagcgtgtcctgttccaggctcatccgtcccaaatccagaagttgaactggtacaaccagcccttaacgggacattaaatgtactgaaagcttgctctgaagtaaaagttggtagggtcgtagttgtatcatcggttgctgcagtatctatgattagagattggccaaaagaccaagttatggatgagaattgttggtcagataaggaatattgcaaggagaccaataactggtactgttattctaagactgttgctgaggctgaagcttgggaatattccaagaagaacggtttaaacatcgttacagtttgccctaccctagtcttgggtcctatgttgcaacatatggctaacgcgtcttctacttcattgattactatgttaaaagaaagtatctctgatatcgaaaacaatctacgcaagatagtagatgttcgcgacgttgcggaggctttaaaactggtatatgaaaaacccgaggcagaaggtaggtatatttgtatggcacatatgatcaaaaacgcagatctgatggatatgttgaagatattttacccaaattacgactacccaaatgacgttaaagaaggtaaggatgagaagaaagtcagttctgaaaaattacaaaaactagggtggaagtttaggccacttaaggaaaccgtcgtagattcggttgaatcttacaagcagcttgggtttttgtggtca

SEQ ID NO: 1385 - DNA, 987 bp, Nepeta cataria
atgagcatcgcagccgctaaaacagtatgcgtcacaggggcatcaggctatatagctagttggatagttaaatttctcttgcaaaagggttatactgttaaggcgagtgtgagagatccaaatgaccaaaaaaaaacacagcaccttctggcattagacggggcaaaggaaaggttacacttgatgaaggcaaaccttttggaggaagggtcctttgactcagtcgttgatggttgtgacggtgtttttcatactgcatctccattctatcatgcggttactgaccctcaggttgaactaattgaacctgcggtgaagggtactctgaatgtgttgggcagttgtgcaaaagtgccctctgttaagcgtatcgtactaacatcatctatagctgctgttgcttataatgggaaacctaggactccggaagtagtggtagatgaaacatggtggtcggccccagatgtttgtgagcagatgcaaatgtggtacgtcttaagtaaaacattagctgaggacgccgcatggaaatttgttaaggagaagggtatcgaaatggtgacaatcaaccccgctatggttataggtccactacttcaaccaacattaaacactagtagtgccgcgattttaaacctaatcaatggtgctgaaacttaccctaatagcacgttcgggtggattaacgtgaaggacgtagcaagagctcacattttggcatttgagaacacttccgcttccggaagatattgtcttgtggaatcggtagttcacacgtctgaggtagtgaaaatcttgcatgaactctatccaacttacaaattacctgataaatgcgctgacgataagccattcgttcctacgtatcaagtttctaaggaaaaggctaaatctttgggtattgaatttacgccattaaaagaaggaataaaagaaactgtggagtcattaaaagaaaaagatatgttcaaaccatctgccgctgtc

SEQ ID NO: 1386 - DNA, 930 bp, Nepeta cataria
atggctgaaaagtcgaaaatactgatcataggtggtactggatatatcggtaaatttattgttgaggcttcagctaaatctggtcacccaacttttgctttggttagagaatctgcagttagtgaccccgctaagagtccattaattcagggttttaaggatagtggtgtgactatcctaataggcgatctaaaggatcatgaatccttgttgaaagctataaaacaggtagacgtggtaatatctactgtaggacagatgcaactggatgatcaggtgaatatcatagcagctattaaagaagcaggcaacatcaagagatttttcccatctgagttcggtaatgatgttgatcgtactagagccgtagaaccggccaaaagtgcattcgctgctaaggcaaaaattagaagagcaattgaagcacaaggtattccatacacttacgtgtcttcaaattactttgctggttactctttacccactttggctcagcccggcgcctttgctccaccacctcctagagataaagtcgttatttatggtgacggcaatgcgaaggcagtcttcaacggggaacatgatataggcacatatacaataaaagctgtggatgatccgaggaccttaaataagattgtttatataaaacctcccaaaaatacttattcctttaatgaactagttgcattgtgggagaagaagattaacaagacgttagagaaagagtttattcccgaggaacaattgctaaagcaaattcaagagagccccatccctgtgaatattatactcagtataaatcatagtatctttgttaagggtgatcagacttatttcacaattgaaccttcgtttggtgtagaggcaagtgagctatacccagatgtcaaatacactaccgtagaagaatttttggatcaattcgtt

SEQ ID NO: 1387 - DNA, 1032 bp, Nepeta cataria
atggcagaagaagtcagtaacaaacaaataatttttaacgattacatcacgggttttcctaaggaatcagacatgatgttaaaaactagtaccataaaacttgaagtgccagaaggctgcgatgatgttgtgctcgttaaaaatttgtatctttcatgtgatccctacatgagaagtcgtatgtccaagctcgacgataactatgtccctattttcacaccaggttcaccaataatgggttatggagtagcaaaggttgtcgactcatgttcgccaaactttaaaaagggagatttaatttggggcatgattggttgggaagagtattcattaatcaaaagtactgatgggctattcaaaattgaacatgaggatgtcccattatcatactatacaggtattctaggtatgcctggtataagtgcttatgttggtttttatgaaatctgttgtccaagggaaggagaaaatgtttttgtatctgccgcctccggagctgtaggtcaactggttggtcaatttgccaaactgctaggttgttatgtggttggttcagcaggtacccaagataaagttgatttgttgaaaaacaaattcggttttgacgaagcttttaattacaaggaagaagttgatttaaatgctgccttgaaaaggcattttcctgagggtatcgatgtatattttgaaaacgtaggtggtaagatgttggaagctgtcctattgaacatgaacatgaaaggtagaattgcagcgtgtggtatgataagtgactataatttaaaagaggctcaaggagttaagaatttgttttccatagttgctaagcagattcgtatgcaaggatttctggtttttcactattattccttgtatcccaaatttctcgatttcatcttgcctctaataaagcaggggaagataacttacgttgaggacgttgcggaaggactagaaagcgctcctcctgccttggtcggtttgtttagtgggcataacgtaggtaaacagttagttcgtgttgttagccag

SEQ ID NO: 1388 - DNA, 948 bp, Nepeta cataria
atggagaagaatgaaagaaaaagcaaaatattaatcttcggtggctcaggttacatcgggtcgtgcatggtaaaagggagtttaaagttgggacactctacttatgttttcagccgtccgaactcctcaaagaagcatttactcaacgagttccaaagtttaggtgctattattgtcaaaggtaaattagatgaacataacaagttggtaagcgttatgaaagaagtagacgttgtcatctctgctttggcgtatccacaagtccttgatcaatttaagatcttggaagctattaaagaggcagggaatattaaacgtttcttaccctctgactttggtgttgaagaagacaagatatccgttttgcccccttttgaggaatttctggataaaaagcgaaaaataagaagagcaatagaagagagtaaaattccgtacaccttcgtctcagctgacgtttttggggcttattttataaattatctgttacatccttatgatccaaacaatcatgaaataaccgtctacggttctggcagagccaaatttgtcatgaattacgaagaagatatcggaatctacaccataaaggtagctaccgacccaagggcatgtaatagaactgttatttataggccatcaaccaatacgttgacacaactggaattgatcagcaagtgggaaaataaaattggtaaaaagttcaaaaaaattcattttcccgaagaagaagttgtggcactgtctcaaaaattaccaaacccagacaatatacccgtggccattttacattccatattcgtcaaaggtgttacaacatgttacgaatttgctgaagatgacgttgaagccagctctttatatcctgatatgaaatttaccactattgatgaactactcgacatatttttgcataatcctccaaaaccagcttccgcagcattcgag

SEQ ID NO: 1389 - DNA, 1026 bp, Nepeta cataria
atggccaaggtagtcctagtcacaggcgcttcagggtacctgggcggtaggctttgccacgcactgcttaaccaaggttattcggtcaaggctttcgttcgtgaaacaagcgcgttatcctatctacccccgccaagggatggcggcgacggtggtggatctttacaattggtttacggagacgttacagattatcctagcttattagaagcctttacgggatgtcacctagtttttcatactgcagccctggtggaaccgtggataccagacccagcaagatttatttcggtgaatgtaggtggcctgcgtaatgttctcaaagcctataaagaaacagaaaccatcgagaaaataatatatacatcatcttttttcgctctgggctctacagacggatacatagctgacgaaacccaagtccatccggctaaacatttctgtacagaatacgagaaatccaagacaatatctgataagattgctttggacgcagctgctgagggcgtacctattgtaccggtctaccctggtgtgatttacggccctggtaaggttacgacgggtaattcagttgcacacttgcttgtggaaagattttctggtagaatgcccggttacgtaggtaaggagcaaggtttctcgttttgccacgttgatgatgtagttcagggccaccttgccgctatggctaaaggtaagaaaggagagaggtatttattgactggcgaaaatgctagttttaaagatgtttttgacatcgctgctgatataacacaaacaagcaagcctcaattccaaatcccacttttcttagtggatgtgtatggctgggtttgcatattgatatcaaggatgacaggtaagcttcccctaatctctcctcctgttgttgacgtactaagacaccagtgggcatactcctgcgagaaagccaaaaaggagttagattacaatcctagatcgctgagggagggtctgctagaaatgttgccttggttgaaaagtttggggttaattaagtat

SEQ ID NO: 1390 - DNA, 972 bp, Nepeta cataria
atgggcaagatcgtatgtgtgaccggcgccagtggctatatagcatcttggttagttaagcttttattacacagaggatacacggttaaggccaccgttcgtaacctgtcagacagatctaaagttgcccacttaacttctttagaaggtgctaacgatagacttcacttatatgaggccaatttactggaagaaggatccttcgacacagcagttgacggttgtgaaggcgtttttcacaccgcatcgccagtgtccttgtctgtatctgatccacaagccgaactcattgatccagctgttaaaggtactatgaatgtcttaaaatcttgtaagaaggtatcaacaattaaaagggtagttgtcacatcgagtatagcctctgtcctgtataactatgattctctgaacctcaaacatgacactattgtcgacgagacttggttcagtgatcctattttttgcgaagaaaataaagaatggtacgccttgtctaagactttagccgaaaaagctgcctggaaatttgcagaagaaaatggtcttgatctagtaactctgcacccaggttatacaatagggccttctcttcaacctactctcaacatgacttatgtagccctgttaaatttgatcaaagagggtaagcaattgctagcaaacggtgtctaccgatatgtagacgtaagagacgtcgctttagcacacatcattgcactggagaatccaagtgctcgtggaagatattgtttagttggaagagtagcttattccttcgaggctctggatatcctgcgtatgatgtttccgaccttaaaattaccacctattgaaacaaaagatagaccaagcaaacccccttatcacgtttccaaggagagagccgagagtcttggtgtttcattccgcccattagaagagtctcttaaagacagtgttgaaagtttcagagaccgtaatctgattacccta

SEQ ID NO: 1391 - DNA, 837 bp, Nepeta cataria
atgtctactaagatggcggaagcattagagccttggagtgatttagaaggtaaaacggttatggttactggcgcgtcgtcaggtttaggccacgaattctgcttggatctggccagagctggctgtcgtattgttgctgccgctagaagaacagatagactcaaatcattgtgcgacgaaattaaccgtatgagaggcggcggatcttgcagggccatggcagtggaattagatgtgacagcgggcggtccaaccatcgctgcatctgttgatagagcgtgggccgcattcggttccatagatactttgataaataatgccggtgtaagaggtgaagttagatcttcactggaattatctgaagaagagtggaactccgtggtaaaaactaatctcaatgggtcatggttagtgtctaagtatgttggcgaaaaaatgcgtagagggggtggcggtgggtccatcataaacatttcctctatcagcgggttgaacagagctcaattgcgtggggggattgcctattcgtcttcaaaagctgggctagatagtatgacaaagataatggcgttagagctgggggatcacaatattagagtgaattcgatcgcccctggtttatttagatccgctatcactgaagatttagttaaaaaagattggttaaaaaatgttgcagagagaagcgtccctttgcgcacgttcggtacttctgatccggcccttacatcattaattagatatttgatacaccatagctcctcatacgtgtccggtaacatattcattgttgatgctggttacactctcccaggctatccaattttttcgagtcta

SEQ ID NO: 1392 - DNA, 1032 bp, Nepeta cataria
atggaagaaaatttggtcggcaacaaacagattattttcaagggttacatagagagggtgccaaaagaatccgacatggaattaaagttaggcaacaaaattaagctggaggctccagaaggttctggcgcgttcctggtcaagaacttgtatttgagttgcgacccatatatgcgtggtaggatgagggatttccatggtagttacattcctccttttcttccggggtcagtcgtcgaaggttttggagtgagcaaagtaattgatagtgataatccaaatttcaaaccaggtgatatagtttccggatttacgggatgggaagaatacagtttgttacataatactgaacaattacggagggtcgaaccagacaatattccattgtcctatcacatcggtttattggggatgccgggttttacagcatacgctggtttctataaagtgtgcgatcccaaaagaaatgaacacgtattcgttagcgccgcatctggcgctgttggtcaattggtcggtcaattagctaaactacacggctgctatgtggttggatcagctggttccgaccagaaagtagatttactaaagaaaaagctgggctttgatgaagccttcaactacaagcaggaacccgatttagatgcggcacttaaaaaatatttccccgaaggtatcgacatttacttcgaaaatgttggcggtgccatgttagaagcagtgctcttaaatatgagagttcacggtcgaatagcagtttgtggaatggtaagtcaaaatggcatggacgaacaagggattagaaatttgtttagcttaattcctaagcgtgttagaatgcaaggtttccttcaatcggattatttgcacctttttcccaagttcgtagaagaggttggcaatttgtataaagagggcaaaataacatacttagaagatatgaaccagggcctagaatctggcccatgtgcgtttgcgggcctgttctcaggcataaacattggtaagcaagttatctgtgtttcaccagct

SEQ ID NO: 1393 - DNA, 963 bp, Nepeta cataria
atggccgataaagagggtgaagtggtgtgtgtcacaggtggttccggcttcataggtagttggttggtctctctgcttcttagaaggggttactcggtgcgagcgacagtcaaaaatttgggggacgagcgtgaaactaagcatttagaggcgattgaaggtgctgattctaggctgagcttattccaaattgacttgcttgattatgattcggttgctacagctgttggggacgccgctggcgtctttcatctagcatccccatgtactatagaccaggttaacgacccgcaacgagaacttctggatccagccattaaaggtacgcttaacgtcttaaaggcagcgaaaaacctaggtgttagaagagttgtggtaactagttctattagtgcaatgatagcatcgtctaactctttagctgagacaggtgaagattgttggattgatgaagattactgtagacaaaacggcttgtggtaccctgtaagcaaagcccttgctgaaaaggctgcctggaagctggctgaagaaaatggtttggacatcgttgtagttaacccaggaatggttgtaggccctatcctaccacctgctcttaattcctctatgcaactgatgttgcatgtcctccagggtaaagactttttcgaaggctttttcatgggtttggttcacgttaaagacgttgctctggcacaaatcttattatacgaaaatacttctgcttccggccgtcatttatgcgtggagtcgctaagtcgctacgatgattttgccaagcaaatggaaaagttatatcctgaatacaaacttcctagattttcaaacaatgcacaacatggctctttaaaatctgatgcagcattgaaaaaattaagagacttaggaattgaatttgctccactggaacaaatagtgaaagattcaattgagtctttgaggtcaaagggttatatttca

SEQ ID NO: 1394 - DNA, 945 bp, Nepeta cataria
atggcggatgctgtcgtacaaccagctgcacagagatatgcattgattacaggagccaacaagggcatcggctttcaaatatgccgacaactagaatcaaaaggtatagtagtgatcttagcctccagagacgaaaaaaggggaattaaagccagggagcgtttgctgaaagaattcggagtgtcgagcgataacgttgttttgcatcagcttgatgttgttgatcccgcctctgtggccgctgtctacgaatttattgaatctagatttgggcgcctcgacatcttggttaacaacgctggcatcaggggagcggatgttgatggtgatgtttcgctccttgaggaatacataaaagctgacggtgctacaattagtgctggtggcaaagccgaaccatttcatccaaaagctaatggaagattggtcgaaacgtttgaaaacgctgaggagtgtattgaaacaaattactacggtgcaaagagggtgacagaagctttgctgcccttgctccaccagtctgatagtcccagaatcgtcaatgtttcatccttgttgggctcattagtgttacaaacgaatgagcgggctaaaggtgtcttcagcaatgaagaaggcttgacccaagacaaagtcgatgaagtggtacaggaatttctgaaagattttaaagaaggaaagttggaagagaataactggccacctcactttccagcttataaagtttcgaaggaggcattgaacgcttacacaatgttactagcaaaaagaaatccgtcgttttgcaccaatgccgtatgcccaggtttttcgagaaccgatatgacctttaactctggtttgatatcagaaagtgaagcagccgaagcacctgtgaagcttgcactgttaccagatggtgggcctagcggctcatttttctacagggaagaagctttatctttg

SEQ ID NO: 1395 - DNA, 930 bp, Nepeta cataria
atgaaagcttggacttataaagaatatggcggtatcgaagttcttaaactagatagcgatgttccgatacccgagcctaaagcggaagaagttctaattaaagttgcagcggtcggtttgaatccaattgattttaagagaagactaggcttctatgaagccgatagagcaccatttcctgttgtcccgggttacgatgttgcaggagttgttgtaaaggttggtaatagggtgatgaactttgaagagggtgacgaagtctacggtgacgtggttgaaacagcattacaagacccaagatctttaggtacgttggccgaatataccattgctgaagaaaagttattggcccttaaaccaagaaatctggatttcgcagaagcggcctcacttccagtagctatccaaacagcatatcaagggttggaaagagccagattcagtgagggtaaatccattttggtgttaggtggcgcgggtggggtaggttcactcgtcatccaagtcgcgagatatgtcttcggagcatctaagatcgctgcaacttgtagtaccgctaacatggacctagttgaatccttaggtgctgatctagtcattgactattcaaatcacaattttgagaactacccagataagtttgatgtcgtctttgatactataggtcagtctgatcgtgctacaaaagcactaaaggagggtggttgcgtcgttgtcattgttggtgagcatgtcgatccaccgatgttctcttttacgctgaccgcttctggagagtatcttaacatgttgaatccttatttggaaacagggatgttaaagccggtcttagatcccaatggtacctttccttttgaccaagtcaacgaagcatttagctacctagagagtaacagagctatcggcaaagtagttgtttatcccatctca

SEQ ID NO: 1396 - DNA, 2589 bp, Artificial Sequence
  source: /note="Description of Artificial Sequence: Synthetic polynucleotide"
atgattatggaacttgtggaagcgactcgtaggaccttaaggaatgagtcatccgatagtaccgaaaagatgagactgattgactctttgcagaggcttgggttgaatcaccattttgagcaggatataaaggaaatgttgcaagactttgccaacgaacacaagaatacaaatcaggacctattcacgactagcctgcgttttaggctgttgagacataatggctttaatgttactccggacgttttcaataaatttacagaggaaaacggtaaatttaaggaatcactaggcgaggataccatcgggattctgtcactatacgaggcaagctatttagggggtaaaggtgaggagatactaagcgaggccatgaagttctccgaatccaagctgagggagtcaagtggtcacgtcgctccccacattcgtagacagatttttcaatccttggagctgccacgtcacctgagaatggctaggttggaatccaggcgttacatagaggaggattactcaaatgagatcggggctgatagctccttactggagctagctaagttagacttcaacagcgtccaagccctacatcagatggaattaacagagatctcaaggtggtggaaacaacttgggctgtcagacaaattgcccttcgcaagagatcgtccgctggaatgttttctgtggaccgtcggattgctaccagagccaaaatattccggatgtcgtattgagttggctaaaacaatagcggtattattggtgatagacgatatttttgatacctacggatcatacgaccagctaatattgtttacgaacgccattagacgttgggatttggacgcaatggacgagttgccggagtacatgaagatatgttatatggcattatacaatactaccaacgagatttgctacaaagtacttaaagaaaacgggtggtcagtccttccctacttagagcgtacttggattgacatggtagaggggttcatgttggaagccaaatggcttaatagcggggaacagccaaatttggaggcttacatagagaacggggtgacaaccgcggggtcttatatggcgcttgtgcatctgttcttcttaattggggatggcgtgaacgatgaaaacgtaaaactgctactagatccttatccaaaacttttttctagtgccgggcgtatccttagactttgggatgacctgggcaccgccaaagaagaacaggaaagaggagacgtttcatcatccatacaactttacatgaaagaaaaaaatgtacgtagtgagagcgaagggagagagggcatcgtagagataatctataacctttggaaagacatgaacggcgaactaatcgggtccaacgcgctaccccaagcaataatagaaacaagctttaacatggcgaggactagccaggtggtctatcaacacgaggacgacacatatttctcctcagttgacaattacgtccagagtctgttcttcaccccagttagcgtgtccgtgggcggtggatctatggcttcagaaaaagaaattaggagagagagattcttgaacgttttccctaaattagtagaggaattgaacgcatcgcttttggcttacggtatgcctaaggaagcatgtgactggtatgcccactcattgaactacaacactccaggcggtaagctaaatagaggtttgtccgttgtggacacgtatgctattctctccaacaagaccgttgaacaattggggcaagaagaatacgaaaaggttgccattctaggttggtgcattgagttgttgcaggcttactggttggtcgccgatgatatgatggacaagtccattaccagaagaggccaaccatgttggtacaaggttcctgaagttggggaaattgccatctgggacgcattcatgttagaggctgctatctacaagcttttgaaatctcacttcagaaacgaaaaatactacatagatatcaccgaattgttccatgaggtcaccttccaaaccgaattgggccaattgatggacttaatcactgcacctgaagacaaagtcgacttgagtaagttctccctaaagaagcactccttcatagttactttcgagactgcttactattctttctacttgcctgtcgcattggccatgtacgttgccggtatcacggatgaaaaggatttgaaacaagccagagatgtcttgattccattgggtgaatacttccaaattcaagatgactacttagactgcttcggtaccccagaacagatcggtaagatcggtacagatatccaagataacaaatgttcttgggtaatcaacaaggcattggaacttgcttccgcagaacaaagaaagactttagacgaaaattacggtaagaaggactcagtcgcagaagccaaatgcaaaaagattttcaatgacttgaaaattgaacagctataccacgaatatgaagagtctattgccaaggatttgaaggccaaaatttctcaggtcgatgagtctcgtggcttcaaagctgatgtcttaactgcgttcttgaacaaagtttacaagagaagcaaa

SEQ ID NO: 1397 - DNA, 2709 bp, Artificial Sequence
  source: /note="Description of Artificial Sequence: Synthetic polynucleotide"
atgagctcctcatcctcttcaagctcatcaatgagcctaccactagctactcctttaataaaggacaatgaatcattgattaagttcctacgccaaccacttgtattaccacatgaggttgacgattctacaaagcgtagagaattactagagcgtacaagaaaagaacttgaattaaacgctgaaaagcctctagaagctcttaaaatgatagatattattcagcgcttgggattatcatatcattttgaagatgatattaattctattctaaccggtttttcaaatatctcaagtcaaacacacgaagacttattgactgcttctttgtgcttcagattgctccgtcacaacggtcataaaataaatccagatattttccaaaagttcatggataataatggtaaattcaaagactctctaaaggatgatacgttgggtatgttatcactgtatgaagcctcttacttgggagctaatggcgaagaaattctaatggaagcacaagaattcacgaagactcatctgaagaacagtctacctgcaatggcaccttctctaagtaaaaaggtgtcacaagctcttgagcagcctagacacagacgaatgttgagattagaagctagacggttcatagaagaatacggtgccgaaaatgatcataatcctgatttgctagaattggcgaaattggattataataaggtgcaatccttacatcaaatggaactctctgagattacaagatggtggaaacaattgggcctagttgataaattaactttcgccagagacagacccttagagtgttttttgtggactgttggcttattacctgaaccaaaatacagcggatgtaggattgaattagctaagacaatcgctatcttattggtaatagacgacatttttgatactcacggtaccttagatgaacttctattatttactaacgccataaagagatgggatttagaagctatggaagacttacctgagtatatgcgtatctgttatatggctctttataacaccactaatgagatttgctataaagtcctgaaggagaatggatggtcagtattaccatatttgaaggccacatggatagacatgatcgagggttttatggtcgaggctgaatggtttaactccgactacgtgccaaacatggaagagtatgtagaaaatggtgtgcgtactgcaggtagttacatggcgctggttcacttattttttttgattggacaaggggtaactgaagataatgtcaaattattgatcaaaccctacccaaaattatttagcagttccggaagaattttacgcctttgggatgatctcggtactgcaaaggaagaacaagaaagaggggacctcgcttcatctatccaattgtttatgagggaaaaagaaattaaaagtgaggaggaaggtcgaaaaggtattttagaaatcattgagaatctatggaaggaacttaatggggaactagtttatcgtgaagaaatgccgctggctataattaagactgcattcaatatggctagggcgtctcaagtagtctatcaacatgaagaagatacttatttttccagcgtagacaactacgttaaggcactattctttacaccgtgtttcggcggtggatctatggcttcagaaaaagaaattaggagagagagattcttgaacgttttccctaaattagtagaggaattgaacgcatcgcttttggcttacggtatgcctaaggaagcatgtgactggtatgcccactcattgaactacaacactccaggcggtaagctaaatagaggtttgtccgttgtggacacgtatgctattctctccaacaagaccgttgaacaattggggcaagaagaatacgaaaaggttgccattctaggttggtgcattgagttgttgcaggcttactggttggtcgccgatgatatgatggacaagtccattaccagaagaggccaaccatgttggtacaaggttcctgaagttggggaaattgccatctgggacgcattcatgttagaggctgctatctacaagcttttgaaatctcacttcagaaacgaaaaatactacatagatatcaccgaattgttccatgaggtcaccttccaaaccgaattgggccaattgatggacttaatcactgcacctgaagacaaagtcgacttgagtaagttctccctaaagaagcactccttcatagttactttcgagactgcttactattctttctacttgcctgtcgcattggccatgtacgttgccggtatcacggatgaaaaggatttgaaacaagccagagatgtcttgattccattgggtgaatacttccaaattcaagatgactacttagactgcttcggtaccccagaacagatcggtaagatcggtacagatatccaagataacaaatgttcttgggtaatcaacaaggcattggaacttgcttccgcagaacaaagaaagactttagacgaaaattacggtaagaaggactcagtcgcagaagccaaatgcaaaaagattttcaatgacttgaaaattgaacagctataccacgaatatgaagagtctattgccaaggatttgaaggccaaaatttctcaggtcgatgagtctcgtggcttcaaagctgatgtcttaactgcgttcttgaacaaagtttacaagagaagcaaa

SEQ ID NO: 1398 - DNA, 3483 bp, Artificial Sequence
  source: /note="Description of Artificial Sequence: Synthetic polynucleotide"
atgacttcagctctctatgctagcgatttatttaaacaattgaagtctatcatgggtacagatagcttaagtgatgatgtagttctagtaatcgcaacaacgagtttggccttagttgctggttttgtcgttctcttgtggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtggggcagtacttcctctggtactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactcta

SEQ ID NO: 1399 - DNA, 3477 bp, Artificial Sequence
  source: /note="Description of Artificial Sequence: Synthetic polynucleotide"
atgacttcagctctctatgctagcgatttatttaaacaattgaagtctatcatgggtacagatagcttaagtgatgatgtagttctagtaatcgcaacaacgagtttggccttagttgctggttttgtcgttctcttgtggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtggggcagtacttcctctggtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcatta

SEQ ID NO: 1400 - DNA, 3495 bp, Artificial Sequence
  source: /note="Description of Artificial Sequence: Synthetic polynucleotide"
atgacttcagctctctatgctagcgatttatttaaacaattgaagtctatcatgggtacagatagcttaagtgatgatgtagttctagtaatcgcaacaacgagtttggccttagttgctggttttgtcgttctcttgtggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtggggttctacttcctccggttcctcaggcggaactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactcta

SEQ ID NO: 1401 - DNA, 3489 bp, Artificial Sequence
  source: /note="Description of Artificial Sequence: Synthetic polynucleotide"
atgacttcagctctctatgctagcgatttatttaaacaattgaagtctatcatgggtacagatagcttaagtgatgatgtagttctagtaatcgcaacaacgagtttggccttagttgctggttttgtcgttctcttgtggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtggggttctacttcctccggttcctcaggcggaggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcatta

SEQ ID NO: 1402 - DNA, 3510 bp, Artificial Sequence
  source: /note="Description of Artificial Sequence: Synthetic polynucleotide"
atgacttcagctctctatgctagcgatttatttaaacaattgaagtctatcatgggtacagatagcttaagtgatgatgtagttctagtaatcgcaacaacgagtttggccttagttgctggttttgtcgttctcttgtggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtggggtggcggctctggcggaagcacatctagcggtagttccggtggtactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactcta

SEQ ID NO: 1403 - DNA, 3504 bp, Artificial Sequence
  source: /note="Description of Artificial Sequence: Synthetic polynucleotide"
atgacttcagctctctatgctagcgatttatttaaacaattgaagtctatcatgggtacagatagcttaagtgatgatgtagttctagtaatcgcaacaacgagtttggccttagttgctggttttgtcgttctcttgtggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtggggtggcggctctggcggaagcacatctagcggtagttccggtggtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcatta

SEQ ID NO: 1404 - DNA, 3561 bp, Artificial Sequence
  source: /note="Description of Artificial Sequence: Synthetic polynucleotide"
atggattctagttcagaaaagttatcaccatttgaattaatgagcgcaattttgaagggagctaagctagatgggtcgaattcgtccgattcaggtgtggcagtttcaccggcagtaatggccatgttgctagagaataaagagctggtcatgattttgactacttccgtggcagtgttgattggttgcgttgttgtgctcatatggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggcagtacttcctctggtactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactcta

SEQ ID NO: 1405 - DNA, 3555 bp, Artificial Sequence
  source: /note="Description of Artificial Sequence: Synthetic polynucleotide"
atggattctagttcagaaaagttatcaccatttgaattaatgagcgcaattttgaagggagctaagctagatgggtcgaattcgtccgattcaggtgtggcagtttcaccggcagtaatggccatgttgctagagaataaagagctggtcatgattttgactacttccgtggcagtgttgattggttgcgttgttgtgctcatatggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggcagtacttcctctggtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcatta

SEQ ID NO: 1406 - DNA, 3573 bp, Artificial Sequence
  source: /note="Description of Artificial Sequence: Synthetic polynucleotide"
atggattctagttcagaaaagttatcaccatttgaattaatgagcgcaattttgaagggagctaagctagatgggtcgaattcgtccgattcaggtgtggcagtttcaccggcagtaatggccatgttgctagagaataaagagctggtcatgattttgactacttccgtggcagtgttgattggttgcgttgttgtgctcatatggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggttctacttcctccggttcctcaggcggaactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactcta

SEQ ID NO: 1407 - DNA, 3567 bp, Artificial Sequence
  source: /note="Description of Artificial Sequence: Synthetic polynucleotide"
atggattctagttcagaaaagttatcaccatttgaattaatgagcgcaattttgaagggagctaagctagatgggtcgaattcgtccgattcaggtgtggcagtttcaccggcagtaatggccatgttgctagagaataaagagctggtcatgattttgactacttccgtggcagtgttgattggttgcgttgttgtgctcatatggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggttctacttcctccggttcctcaggcggaggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcatta

SEQ ID NO: 1408 - DNA, 3588 bp, Artificial Sequence
  source: /note="Description of Artificial Sequence: Synthetic polynucleotide"
atggattctagttcagaaaagttatcaccatttgaattaatgagcgcaattttgaagggagctaagctagatgggtcgaattcgtccgattcaggtgtggcagtttcaccggcagtaatggccatgttgctagagaataaagagctggtcatgattttgactacttccgtggcagtgttgattggttgcgttgttgtgctcatatggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggtggcggctctggcggaagcacatctagcggtagttccggtggtactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactcta

SEQ ID NO: 1409 - DNA, 3582 bp, Artificial Sequence
  source: /note="Description of Artificial Sequence: Synthetic polynucleotide"
atggattctagttcagaaaagttatcaccatttgaattaatgagcgcaattttgaagggagctaagctagatgggtcgaattcgtccgattcaggtgtggcagtttcaccggcagtaatggccatgttgctagagaataaagagctggtcatgattttgactacttccgtggcagtgttgattggttgcgttgttgtgctcatatggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggtggcggctctggcggaagcacatctagcggtagttccggtggtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcatta

SEQ ID NO: 1410 - DNA, 3423 bp, Artificial Sequence
  source: /note="Description of Artificial Sequence: Synthetic polynucleotide"
atggattacctgactataatacttacacttctcttcgctctaactctttacgaagctttttcttatttatcacgaagaactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactctaggcagtacttcctctggttggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtgg

SEQ ID NO: 1411 - DNA, 3435 bp, Artificial Sequence
  source: /note="Description of Artificial Sequence: Synthetic polynucleotide"
atggattacctgactataatacttacacttctcttcgctctaactctttacgaagctttttcttatttatcacgaagaactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactctaggcagtacttcctctggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1412 - DNA, 3435 bp, Artificial Sequence
  source: /note="Description of Artificial Sequence: Synthetic polynucleotide"
atggattacctgactataatacttacacttctcttcgctctaactctttacgaagctttttcttatttatcacgaagaactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactctaggttctacttcctccggttcctcaggcggatggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtgg

SEQ ID NO: 1413 - DNA, 3447 bp, Artificial Sequence
  source: /note="Description of Artificial Sequence: Synthetic polynucleotide"
atggattacctgactataatacttacacttctcttcgctctaactctttacgaagctttttcttatttatcacgaagaactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactctaggttctacttcctccggttcctcaggcggatggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1414 - DNA, 3450 bp, Artificial Sequence
  source: /note="Description of Artificial Sequence: Synthetic polynucleotide"
atggattacctgactataatacttacacttctcttcgctctaactctttacgaagctttttcttatttatcacgaagaactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactctaggtggcggctctggcggaagcacatctagcggtagttccggtggttggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtgg

SEQ ID NO: 1415 - DNA, 3462 bp, Artificial Sequence
  source: /note="Description of Artificial Sequence: Synthetic polynucleotide"
atggattacctgactataatacttacacttctcttcgctctaactctttacgaagctttttcttatttatcacgaagaactaaaaacttacctccaggtccgtcgccactgccatttatcggttctttacatctattgggtgatcaacctcataagtccttggctaaattgtcaaagaaacacggaccgattatgtcgctaaaattaggtcaaatcactaccattgttatatcttcatccaccatggcgaaggaagttttgcagaagcaggatttggccttttcatctagatctgtaccgaatgcgttgcacgcccataaccaatttaaattcagcgttgtatggctaccagtggcatcaaggtggaggtcactcagaaaggtccttaattccaatattttctcgggaaatagattagacgcaaaccaacacttgagaacacggaaagtccaggaattaatagcatactgtagaaaaaactcgcaaagtggtgaagccgtggatgtgggtagagccgcatttagaacttcattaaatctattgtccaatcttattttctcaaaagatctaacggacccatacagcgactctgcaaaagaattcaaggatcttgtttggaacatcatggttgaagcaggcaaacccaacttagtggactttttcccattattagaaaaagttgatccacaaggaatcagacatcgaatgactattcattttggtgaagtgctaaagttatttggtggtttagtcaacgagagactagaacaaaggaggtcaaaaggcgaaaagaacgatgtcctggatgtcttacttactacttcacaggaaagtcctgaagagattgatagaactcacattgaaagaatgtgtttagatttattcgtcgcaggtaccgatacgacaagttctacattagagtgggctatgtcagagatgcttaagaatccagacaaaatgaagaaaactcaagatgaactagctcaagttattggcaggggtaaaaccattgaagaatcagatattaatcgtctaccttatttgaggtgtgtcatgaaggaaactttaagaatacatcctcctgtaccattcctgattccaagaaaggttgagcaatccgttgaagtttgtggttataatgtaccgaaaggttcacaagtattagtcaatgcctgggcaattggcagagacgaaactgtatgggacgatgccttagcattcaagccagaacgctttatggaaagtgaactagatatacgaggcagagactttgagttgattccatttggtgctggccggagaatttgtcctgggttaccgttagctttgcgtacagttccacttatgttgggatccctacttaactcattcaattggaaattggaagggggaatggctcctaaggacttggacatggaggaaaaatttggcatcactttgcaaaaggcacacccacttagagccgtaccatcgactctaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1416 - DNA, 3420 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggcagtacttcctctggttggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtgg

SEQ ID NO: 1417 - DNA, 3432 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggcagtacttcctctggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1418 - DNA, 3432 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggttctacttcctccggttcctcaggcggatggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtgg

SEQ ID NO: 1419 - DNA, 3444 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggttctacttcctccggttcctcaggcggatggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1420 - DNA, 3447 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggaaaaaaacgactgcagacagatcaggtgagttgaaaccactgatgattccaaaatctctgatggctaaagacgaagatgatgacttggatcttggctctggcaagacaagagtttctatcttttttggtacacaaactggtacggctgaagggttcgccaaagccttaagtgaagaaattaaagcaaggtatgaaaaggcggccgtgaaagatgactacgctgcagatgatgaccaatacgaagaaaagctcaaaaaagagactcttgcttttttctgcgttgctacgtacggtgatggagaaccaacagacaacgccgcgagattttataaatggtttactgaagaaaatgaaagagacattaagcttcagcagctagcatacggagttttcgctctcggtaatagacagtatgaacattttaacaagattggaatagtcctagatgaggaattgtgcaaaaaaggagctaagagactgattgaagttggattgggtgatgatgatcagtcaattgaagatgattttaatgcgtggaaagagtcgttgtggagcgaattagataagctactgaaggatgaagatgataaatctgtggctacaccctacaccgccgttatcccagagtacagggtagttacccatgatcctagatttacaactcaaaaatccatggagagtaatgtggcaaacggaaataccactatcgatatccatcatccctgtcgtgtagacgttgctgtgcagaaagagttacacactcatgaatctgatagatcttgtattcacttggagttcgacatttcgagaacaggtataacatacgaaactggggatcacgtcggtgtttatgccgaaaatcatgttgagatcgttgaagaagccggtaaacttttgggtcacagtttggaccttgttttttcaattcacgccgataaagaggacggctcacctttagaatctgcagtgccccccccctttccggggccatgtacgcttggcacaggtctagcgagatacgcagatcttctcaatccacctagaaagtcagctctcgttgcattagcagcttatgcaactgaaccgtctgaggccgagaagttgaagcacttgacctctccggatggtaaagatgagtatagtcagtggattgtagcatctcagagaagtttattggaggtcatggctgcttttccaagcgctaagcctcctctaggtgtctttttcgctgctatcgctcctaggctacagccgagatattacagcatatcatcctctccaagattggctccatcgcgcgtacacgtgacttccgctctggtatatggaccaaccccaaccggtagaattcacaaaggtgtctgctcaacatggatgaaaaacgcagtgccagccgagaagtcacatgagtgtagtggtgctccaatattcataagagcctctaatttcaaacttccaagcaatccgtctacaccaatcgtcatggttggtcccggaacaggtttggctccatttaggggatttctacaagagaggatggcattaaaagaagatggtgaagaattagggagctcgttgttatttttcggatgccgaaatcgtcaaatggacttcatttacgaagatgaattgaacaactttgttgaccaaggtgttatttcagagctaataatggcgttcagtagagaaggagcacaaaaagaatacgtccaacataaaatgatggaaaaagctgcccaagtttgggatttgattaaagaagaaggttatttatatgtgtgtggagatgctaaaggtatggcaagagatgttcataggacacttcatactatagttcaggaacaagaaggcgtatcgagtagcgaggcggaggctatagttaaaaaattgcaaacagagggtcgttacctgagagatgtgtgg

SEQ ID NO: 1421 - DNA, 3459 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1422 - DNA, 3423 bp, Artificial Sequence
  source: /note="Description of Artificial Sequence: Synthetic polynucleotide"
atggctttgttactggcggtatttcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1423 - DNA, 3408 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1424 - DNA, 3417 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggtcctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1425 - DNA, 3351 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggtactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1426 - DNA, 3453 bp, Artificial Sequence
  source: /note="Description of Artificial Sequence: Synthetic polynucleotide"
atggacttcctgactattgtgcttggcctcctgttcacacttgtgctcgttcacggactccagactctttctgctagggccaagaaactccctcctgggcccacgcctctaccacttatcggctctctgcacctcctgggcgaccagcctcaccaatctcttgctaagcttgcgaagactcacgggcccctcatgtgtctccgcttgggatttattaacacggtcgttgtatcgtcggcagcaatggcgaaggaggttctccaaaaacaggatctcgtcttcagcagtagaaccataccggatgctattcacgcacacgaccagtttaagtactctgttgtctggttgcccgtcgcttcacgatggcgtagtctgcgtaaggtgctcaactcgaacatcttctctggctcccgtctggacgccaaccagcacctacgatgccgtaaggtgcaggagctcatcgcctattgcaggaagaattcacagaccggtgagccagtggacgtgggacgagccgcgttccgaacctcccttaacctcctttctaacaccatcttttcgaaggatctgacagaccctttttctgactctgccaaggaatttaaggacctcgtgtggaacattatggtcgaggctggaaagccaaacctggtcgatttctttccaatgctcgaaaagcttgatccccagggcatacgaagacgaatgaccattcatttcggaaaggtgatcgatctgtttagtggtcttatcaacgaacggctggaaaagggtaagactcagaacgctggtaactccgatgttatcgacatcctcttggcaacttctaaggaaaacccagaggagattgaccgagttcacatcgaacgtatgtgcctggatttgtttgtagctggcaccgacaccacatcgtctacgctggagtgggcaatggccgaggccctgaagaaccccgagacggtcaagaaggctaaggcggagctcgaagaggtgatcggtaagggcaaggtcctcgacgaggctgacatttcacgtttgccctacctacgctgcatggtgaaggagacgctaagaatccacccccctgtaccattcttgattccccgaagggtggaccaggatgtggaggtttgtggttacaccgttcccaagaactctcaggtcttcgtgaatgcctgggccattggtcgggaccccgatgtctggaaggaccccctcgaattcaagcccgagcgattcttggagtccgaactcgacatgcgaggacgagacttcgagctgattccctttggtgcaggacggcggatttgtccgggtttgcccctcgccgtgcgaatggtccccgtgatgctcggttcgctgctgaatagcttcgactggaaactggaaaacggcatcggtcccaaggaactggatatggatgaaaagttcggcatcaccctccagaaggctagacccctcagagctgtgcctcttcctctcggtggcggctctggcggaagcacatctagcggtagttccggtggttggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1427 - DNA, 3465 bp, Artificial Sequence
  source: /note="Description of Artificial Sequence: Synthetic polynucleotide"
atggacttcctgactattgtgcttggcctcctgttcacacttgtgctcgttcacggactccagactctttctgctagggccaagaaactccctcctgggcccacgcctctaccacttatcggctctctgcacctcctgggcgaccagcctcaccaatctcttgctaagcttgcgaagactcacgggcccctcatgtgtctccgcttgggatttattaacacggtcgttgtatcgtcggcagcaatggcgaaggaggttctccaaaaacaggatctcgtcttcagcagtagaaccataccggatgctattcacgcacacgaccagtttaagtactctgttgtctggttgcccgtcgcttcacgatggcgtagtctgcgtaaggtgctcaactcgaacatcttctctggctcccgtctggacgccaaccagcacctacgatgccgtaaggtgcaggagctcatcgcctattgcaggaagaattcacagaccggtgagccagtggacgtgggacgagccgcgttccgaacctcccttaacctcctttctaacaccatcttttcgaaggatctgacagaccctttttctgactctgccaaggaatttaaggacctcgtgtggaacattatggtcgaggctggaaagccaaacctggtcgatttctttccaatgctcgaaaagcttgatccccagggcatacgaagacgaatgaccattcatttcggaaaggtgatcgatctgtttagtggtcttatcaacgaacggctggaaaagggtaagactcagaacgctggtaactccgatgttatcgacatcctcttggcaacttctaaggaaaacccagaggagattgaccgagttcacatcgaacgtatgtgcctggatttgtttgtagctggcaccgacaccacatcgtctacgctggagtgggcaatggccgaggccctgaagaaccccgagacggtcaagaaggctaaggcggagctcgaagaggtgatcggtaagggcaaggtcctcgacgaggctgacatttcacgtttgccctacctacgctgcatggtgaaggagacgctaagaatccacccccctgtaccattcttgattccccgaagggtggaccaggatgtggaggtttgtggttacaccgttcccaagaactctcaggtcttcgtgaatgcctgggccattggtcgggaccccgatgtctggaaggaccccctcgaattcaagcccgagcgattcttggagtccgaactcgacatgcgaggacgagacttcgagctgattccctttggtgcaggacggcggatttgtccgggtttgcccctcgccgtgcgaatggtccccgtgatgctcggttcgctgctgaatagcttcgactggaaactggaaaacggcatcggtcccaaggaactggatatggatgaaaagttcggcatcaccctccagaaggctagacccctcagagctgtgcctcttcctctcggtggcggctctggcggaagcacatctagcggtagttccggtggttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1428 - DNA, 3465 bp, Artificial Sequence
  source: /note="Description of Artificial Sequence: Synthetic polynucleotide"
atggacttcctgactattgtgcttggcctcctgttcacacttgtgctcgttcacggactccagactctttctgctagggccaagaaactccctcctgggcccacgcctctaccacttatcggctctctgcacctcctgggcgaccagcctcaccaatctcttgctaagcttgcgaagactcacgggcccctcatgtgtctccgcttgggatttattaacacggtcgttgtatcgtcggcagcaatggcgaaggaggttctccaaaaacaggatctcgtcttcagcagtagaaccataccggatgctattcacgcacacgaccagtttaagtactctgttgtctggttgcccgtcgcttcacgatggcgtagtctgcgtaaggtgctcaactcgaacatcttctctggctcccgtctggacgccaaccagcacctacgatgccgtaaggtgcaggagctcatcgcctattgcaggaagaattcacagaccggtgagccagtggacgtgggacgagccgcgttccgaacctcccttaacctcctttctaacaccatcttttcgaaggatctgacagaccctttttctgactctgccaaggaatttaaggacctcgtgtggaacattatggtcgaggctggaaagccaaacctggtcgatttctttccaatgctcgaaaagcttgatccccagggcatacgaagacgaatgaccattcatttcggaaaggtgatcgatctgtttagtggtcttatcaacgaacggctggaaaagggtaagactcagaacgctggtaactccgatgttatcgacatcctcttggcaacttctaaggaaaacccagaggagattgaccgagttcacatcgaacgtatgtgcctggatttgtttgtagctggcaccgacaccacatcgtctacgctggagtgggcaatggccgaggccctgaagaaccccgagacggtcaagaaggctaaggcggagctcgaagaggtgatcggtaagggcaaggtcctcgacgaggctgacatttcacgtttgccctacctacgctgcatggtgaaggagacgctaagaatccacccccctgtaccattcttgattccccgaagggtggaccaggatgtggaggtttgtggttacaccgttcccaagaactctcaggtcttcgtgaatgcctgggccattggtcgggaccccgatgtctggaaggaccccctcgaattcaagcccgagcgattcttggagtccgaactcgacatgcgaggacgagacttcgagctgattccctttggtgcaggacggcggatttgtccgggtttgcccctcgccgtgcgaatggtccccgtgatgctcggttcgctgctgaatagcttcgactggaaactggaaaacggcatcggtcccaaggaactggatatggatgaaaagttcggcatcaccctccagaaggctagacccctcagagctgtgcctcttcctctcggtggcggctctggcggaagcacatctagcggtagttccggtggttggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1429 - DNA, 3465 bp, Artificial Sequence
  source: /note="Description of Artificial Sequence: Synthetic polynucleotide"
atggacttcctgactattgtgcttggcctcctgttcacacttgtgctcgttcacggactccagactctttctgctagggccaagaaactccctcctgggcccacgcctctaccacttatcggctctctgcacctcctgggcgaccagcctcaccaatctcttgctaagcttgcgaagactcacgggcccctcatgtgtctccgcttgggatttattaacacggtcgttgtatcgtcggcagcaatggcgaaggaggttctccaaaaacaggatctcgtcttcagcagtagaaccataccggatgctattcacgcacacgaccagtttaagtactctgttgtctggttgcccgtcgcttcacgatggcgtagtctgcgtaaggtgctcaactcgaacatcttctctggctcccgtctggacgccaaccagcacctacgatgccgtaaggtgcaggagctcatcgcctattgcaggaagaattcacagaccggtgagccagtggacgtgggacgagccgcgttccgaacctcccttaacctcctttctaacaccatcttttcgaaggatctgacagaccctttttctgactctgccaaggaatttaaggacctcgtgtggaacattatggtcgaggctggaaagccaaacctggtcgatttctttccaatgctcgaaaagcttgatccccagggcatacgaagacgaatgaccattcatttcggaaaggtgatcgatctgtttagtggtcttatcaacgaacggctggaaaagggtaagactcagaacgctggtaactccgatgttatcgacatcctcttggcaacttctaaggaaaacccagaggagattgaccgagttcacatcgaacgtatgtgcctggatttgtttgtagctggcaccgacaccacatcgtctacgctggagtgggcaatggccgaggccctgaagaaccccgagacggtcaagaaggctaaggcggagctcgaagaggtgatcggtaagggcaaggtcctcgacgaggctgacatttcacgtttgccctacctacgctgcatggtgaaggagacgctaagaatccacccccctgtaccattcttgattccccgaagggtggaccaggatgtggaggtttgtggttacaccgttcccaagaactctcaggtcttcgtgaatgcctgggccattggtcgggaccccgatgtctggaaggaccccctcgaattcaagcccgagcgattcttggagtccgaactcgacatgcgaggacgagacttcgagctgattccctttggtgcaggacggcggatttgtccgggtttgcccctcgccgtgcgaatggtccccgtgatgctcggttcgctgctgaatagcttcgactggaaactggaaaacggcatcggtcccaaggaactggatatggatgaaaagttcggcatcaccctccagaaggctagacccctcagagctgtgcctcttcctctcggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1430 - DNA, 3450 bp, Artificial Sequence
  source: /note="Description of Artificial Sequence: Synthetic polynucleotide"
atggactacctgaccattgcactcggttttctgttcgccctaaccctgtaccaggccttgatttctttctcccggaagtctaagaacctaccccctggtccggcaccacttccctttattggaaatcttcacctgctgggtgaccagccacacaagtctcttgcaaagctagcgaagaagcacggacccatcatgggcctccagttcggacaagtgacaaccattgtcgttacaagctccggcatggccaaggaggtccttcagaagcaggacctggctttttcgtcgcgatccgtgcccaacgcacttcacgctcacgatcaatacaaatacagcgtcatttggcttcccgtggccagccaatggaggtccctccggaaagtgctgaactctaacatcttctcgggaaatcggctggacgcaaaccagcatctaagatgccgcaaggttcaagagctcattgcttactgccgaaagaactgccagacaggcgaagccgtcgatcttggtcgggcggcctttcgaactagtctgaacctcctgtcgaataccatctttagcaaggatctcaccgatccttacagtgatagcgctaaggaatttaaagatctggtttggaatgtgatggtggaggctggcaagcccaatctcgtcgacttcttccccgttctggacaaggttgaccctcagggaattagaaagcgaatgactttccacttcggtaaaatcctccagctgttcggtggcctcatcaatgagaggttgcagcagaacaaggcgaagggcgctcacaaagacgtgctcgatgtgctgcttaagacctcgcaggagactcccgacgagctcaaccgaacccatatcgaacgaatgtgtctcgacctctttgtggctggaactgataccacttcctccaccctggagtgggctatggcggagatgctgaagagcccggacaaaatgaacaaggccaaggaggagctggcacaggtgatcgggaaaggcaaggccgttgaagaggccgatatcgcgagcctcccatacctccggtgcgccataaaggaaacgctgagaatccaccctcccgtgcctttcttaatccctcgacggactgagcaggaggtcgaggtttgtggatacactgtacctaaaaactcccaggtgtttgtcaacgtctgggctatcggccgagatgagaccacgtggcctgacgccctagagttcaagcccgagcgttttctggaaagtgaaattgacatgcggggtcgggacttcgagcttctgccctttggcgccggtcgacgaatctgccccggcttcccattggcggtgagaatggtgccggtcatgcttgggtcactgctaaattccttcgactggaagcttgagggtggaattgcccccaaggatctcgacatggaggagaaattcggtattacgctacaaaaggctcatccccttcgagctattcccacctccttgggtggcggctctggcggaagcacatctagcggtagttccggtggttggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1431 - DNA, 3462 bp, Artificial Sequence
  source: /note="Description of Artificial Sequence: Synthetic polynucleotide"
atggactacctgaccattgcactcggttttctgttcgccctaaccctgtaccaggccttgatttctttctcccggaagtctaagaacctaccccctggtccggcaccacttccctttattggaaatcttcacctgctgggtgaccagccacacaagtctcttgcaaagctagcgaagaagcacggacccatcatgggcctccagttcggacaagtgacaaccattgtcgttacaagctccggcatggccaaggaggtccttcagaagcaggacctggctttttcgtcgcgatccgtgcccaacgcacttcacgctcacgatcaatacaaatacagcgtcatttggcttcccgtggccagccaatggaggtccctccggaaagtgctgaactctaacatcttctcgggaaatcggctggacgcaaaccagcatctaagatgccgcaaggttcaagagctcattgcttactgccgaaagaactgccagacaggcgaagccgtcgatcttggtcgggcggcctttcgaactagtctgaacctcctgtcgaataccatctttagcaaggatctcaccgatccttacagtgatagcgctaaggaatttaaagatctggtttggaatgtgatggtggaggctggcaagcccaatctcgtcgacttcttccccgttctggacaaggttgaccctcagggaattagaaagcgaatgactttccacttcggtaaaatcctccagctgttcggtggcctcatcaatgagaggttgcagcagaacaaggcgaagggcgctcacaaagacgtgctcgatgtgctgcttaagacctcgcaggagactcccgacgagctcaaccgaacccatatcgaacgaatgtgtctcgacctctttgtggctggaactgataccacttcctccaccctggagtgggctatggcggagatgctgaagagcccggacaaaatgaacaaggccaaggaggagctggcacaggtgatcgggaaaggcaaggccgttgaagaggccgatatcgcgagcctcccatacctccggtgcgccataaaggaaacgctgagaatccaccctcccgtgcctttcttaatccctcgacggactgagcaggaggtcgaggtttgtggatacactgtacctaaaaactcccaggtgtttgtcaacgtctgggctatcggccgagatgagaccacgtggcctgacgccctagagttcaagcccgagcgttttctggaaagtgaaattgacatgcggggtcgggacttcgagcttctgccctttggcgccggtcgacgaatctgccccggcttcccattggcggtgagaatggtgccggtcatgcttgggtcactgctaaattccttcgactggaagcttgagggtggaattgcccccaaggatctcgacatggaggagaaattcggtattacgctacaaaaggctcatccccttcgagctattcccacctccttgggtggcggctctggcggaagcacatctagcggtagttccggtggttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1432 - DNA, 3462 bp, Artificial Sequence
  source: /note="Description of Artificial Sequence: Synthetic polynucleotide"
atggactacctgaccattgcactcggttttctgttcgccctaaccctgtaccaggccttgatttctttctcccggaagtctaagaacctaccccctggtccggcaccacttccctttattggaaatcttcacctgctgggtgaccagccacacaagtctcttgcaaagctagcgaagaagcacggacccatcatgggcctccagttcggacaagtgacaaccattgtcgttacaagctccggcatggccaaggaggtccttcagaagcaggacctggctttttcgtcgcgatccgtgcccaacgcacttcacgctcacgatcaatacaaatacagcgtcatttggcttcccgtggccagccaatggaggtccctccggaaagtgctgaactctaacatcttctcgggaaatcggctggacgcaaaccagcatctaagatgccgcaaggttcaagagctcattgcttactgccgaaagaactgccagacaggcgaagccgtcgatcttggtcgggcggcctttcgaactagtctgaacctcctgtcgaataccatctttagcaaggatctcaccgatccttacagtgatagcgctaaggaatttaaagatctggtttggaatgtgatggtggaggctggcaagcccaatctcgtcgacttcttccccgttctggacaaggttgaccctcagggaattagaaagcgaatgactttccacttcggtaaaatcctccagctgttcggtggcctcatcaatgagaggttgcagcagaacaaggcgaagggcgctcacaaagacgtgctcgatgtgctgcttaagacctcgcaggagactcccgacgagctcaaccgaacccatatcgaacgaatgtgtctcgacctctttgtggctggaactgataccacttcctccaccctggagtgggctatggcggagatgctgaagagcccggacaaaatgaacaaggccaaggaggagctggcacaggtgatcgggaaaggcaaggccgttgaagaggccgatatcgcgagcctcccatacctccggtgcgccataaaggaaacgctgagaatccaccctcccgtgcctttcttaatccctcgacggactgagcaggaggtcgaggtttgtggatacactgtacctaaaaactcccaggtgtttgtcaacgtctgggctatcggccgagatgagaccacgtggcctgacgccctagagttcaagcccgagcgttttctggaaagtgaaattgacatgcggggtcgggacttcgagcttctgccctttggcgccggtcgacgaatctgccccggcttcccattggcggtgagaatggtgccggtcatgcttgggtcactgctaaattccttcgactggaagcttgagggtggaattgcccccaaggatctcgacatggaggagaaattcggtattacgctacaaaaggctcatccccttcgagctattcccacctccttgggtggcggctctggcggaagcacatctagcggtagttccggtggttggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1433 - DNA, 3462 bp, Artificial Sequence
  source: /note="Description of Artificial Sequence: Synthetic polynucleotide"
atggactacctgaccattgcactcggttttctgttcgccctaaccctgtaccaggccttgatttctttctcccggaagtctaagaacctaccccctggtccggcaccacttccctttattggaaatcttcacctgctgggtgaccagccacacaagtctcttgcaaagctagcgaagaagcacggacccatcatgggcctccagttcggacaagtgacaaccattgtcgttacaagctccggcatggccaaggaggtccttcagaagcaggacctggctttttcgtcgcgatccgtgcccaacgcacttcacgctcacgatcaatacaaatacagcgtcatttggcttcccgtggccagccaatggaggtccctccggaaagtgctgaactctaacatcttctcgggaaatcggctggacgcaaaccagcatctaagatgccgcaaggttcaagagctcattgcttactgccgaaagaactgccagacaggcgaagccgtcgatcttggtcgggcggcctttcgaactagtctgaacctcctgtcgaataccatctttagcaaggatctcaccgatccttacagtgatagcgctaaggaatttaaagatctggtttggaatgtgatggtggaggctggcaagcccaatctcgtcgacttcttccccgttctggacaaggttgaccctcagggaattagaaagcgaatgactttccacttcggtaaaatcctccagctgttcggtggcctcatcaatgagaggttgcagcagaacaaggcgaagggcgctcacaaagacgtgctcgatgtgctgcttaagacctcgcaggagactcccgacgagctcaaccgaacccatatcgaacgaatgtgtctcgacctctttgtggctggaactgataccacttcctccaccctggagtgggctatggcggagatgctgaagagcccggacaaaatgaacaaggccaaggaggagctggcacaggtgatcgggaaaggcaaggccgttgaagaggccgatatcgcgagcctcccatacctccggtgcgccataaaggaaacgctgagaatccaccctcccgtgcctttcttaatccctcgacggactgagcaggaggtcgaggtttgtggatacactgtacctaaaaactcccaggtgtttgtcaacgtctgggctatcggccgagatgagaccacgtggcctgacgccctagagttcaagcccgagcgttttctggaaagtgaaattgacatgcggggtcgggacttcgagcttctgccctttggcgccggtcgacgaatctgccccggcttcccattggcggtgagaatggtgccggtcatgcttgggtcactgctaaattccttcgactggaagcttgagggtggaattgcccccaaggatctcgacatggaggagaaattcggtattacgctacaaaaggctcatccccttcgagctattcccacctccttgggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1434 - DNA, 3450 bp, Artificial Sequence
  source: /note="Description of Artificial Sequence: Synthetic polynucleotide"
atggattaccttacaattactttgggactcctcttcgccctcaccttctatcagggactgtcctacctgtcacgacgatctaaaaagctcccccctggaccggctccccttcccatcatcgggaacctccacatgctgggggatcagccccataagtctctggccaagctctcaaagaagcatggtccgatcatgtctcttaagctgggacaaatcaccacagttgtggtgtcttcttctggaatggctaaggaagtcctgcagaaacacgacttggcctttagtagtcgatctattcctaacgccctgcacgctcataaccagtatcagttcagcgtcgtttggctccccgtcgcttcccgttggcgatcgctgcgaaagaccctcaactcgaacattttctcgggtaacaggttggatgccaatcagcacttgagatcccgaaaggtcgaagagttaatcgcttactgccgaaagaactgtcagacaggcgaggccgtcgacgtcggccgggcagccttccggacatcgttgaacttgctctccaacctcatcttctccaaggatctgaccgatccttattcggattcagctaaggaattcaaggacctcgtctggaatatcatggtcgaggctggaaagccaaacttggtcgattattttcccgtactcgagaaagtcgaccctcagggcatcagacgacgaatgactgtccatttcggaaaagttctcaagctgttcgacggtcttgtgaatgagcgactagagcagcgtcgtagccgaggaggaaagaatgatgtgttggacgtgctgcttactaactcagaggagaaccccgaggagattgatcgaacgcacattgagcggatgtgcttggacctattcgttgcaggtactgatacgacttcatctactcttgagtgggccatggccgagatgctgaagaaccctgataagatgaagaagacgcaggccgagctagctgaggtgatcggcagaggtaaggcgattgaggagagcgacctccctcgactgccttaccttcgatgtgttgtgaaagaaaccctgcgaattcaccctccggtccccttcctgattcccaggcgagtcgagcaagacgttgaggtgtgtggctataaggtccctaagggatctcaagtcctggtcaacgcgtggacaatcgggcgagacgaggccgtctgggaggacgctctagcttttaagcccgaacggttcctcgagtccgagctggacattagaggacgagatttcgagttgattccattcggagctggtcgtagaatttgccctggtctacccctcgccttgcggacagtccctctcatggtcggctctctgctcaactcgttcaattggaagctggagggcggaatcacccctaaggacctggacatggaagaaaagttcggcataaccctgcagaaggcacatcctctgagagccgtgcctatccctttcggtggcggctctggcggaagcacatctagcggtagttccggtggttggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1435 - DNA, 3462 bp, Artificial Sequence
  source: /note="Description of Artificial Sequence: Synthetic polynucleotide"
atggattaccttacaattactttgggactcctcttcgccctcaccttctatcagggactgtcctacctgtcacgacgatctaaaaagctcccccctggaccggctccccttcccatcatcgggaacctccacatgctgggggatcagccccataagtctctggccaagctctcaaagaagcatggtccgatcatgtctcttaagctgggacaaatcaccacagttgtggtgtcttcttctggaatggctaaggaagtcctgcagaaacacgacttggcctttagtagtcgatctattcctaacgccctgcacgctcataaccagtatcagttcagcgtcgtttggctccccgtcgcttcccgttggcgatcgctgcgaaagaccctcaactcgaacattttctcgggtaacaggttggatgccaatcagcacttgagatcccgaaaggtcgaagagttaatcgcttactgccgaaagaactgtcagacaggcgaggccgtcgacgtcggccgggcagccttccggacatcgttgaacttgctctccaacctcatcttctccaaggatctgaccgatccttattcggattcagctaaggaattcaaggacctcgtctggaatatcatggtcgaggctggaaagccaaacttggtcgattattttcccgtactcgagaaagtcgaccctcagggcatcagacgacgaatgactgtccatttcggaaaagttctcaagctgttcgacggtcttgtgaatgagcgactagagcagcgtcgtagccgaggaggaaagaatgatgtgttggacgtgctgcttactaactcagaggagaaccccgaggagattgatcgaacgcacattgagcggatgtgcttggacctattcgttgcaggtactgatacgacttcatctactcttgagtgggccatggccgagatgctgaagaaccctgataagatgaagaagacgcaggccgagctagctgaggtgatcggcagaggtaaggcgattgaggagagcgacctccctcgactgccttaccttcgatgtgttgtgaaagaaaccctgcgaattcaccctccggtccccttcctgattcccaggcgagtcgagcaagacgttgaggtgtgtggctataaggtccctaagggatctcaagtcctggtcaacgcgtggacaatcgggcgagacgaggccgtctgggaggacgctctagcttttaagcccgaacggttcctcgagtccgagctggacattagaggacgagatttcgagttgattccattcggagctggtcgtagaatttgccctggtctacccctcgccttgcggacagtccctctcatggtcggctctctgctcaactcgttcaattggaagctggagggcggaatcacccctaaggacctggacatggaagaaaagttcggcataaccctgcagaaggcacatcctctgagagccgtgcctatccctttcggtggcggctctggcggaagcacatctagcggtagttccggtggttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1436 - DNA, 3462 bp, Artificial Sequence
  source: /note="Description of Artificial Sequence: Synthetic polynucleotide"
atggattaccttacaattactttgggactcctcttcgccctcaccttctatcagggactgtcctacctgtcacgacgatctaaaaagctcccccctggaccggctccccttcccatcatcgggaacctccacatgctgggggatcagccccataagtctctggccaagctctcaaagaagcatggtccgatcatgtctcttaagctgggacaaatcaccacagttgtggtgtcttcttctggaatggctaaggaagtcctgcagaaacacgacttggcctttagtagtcgatctattcctaacgccctgcacgctcataaccagtatcagttcagcgtcgtttggctccccgtcgcttcccgttggcgatcgctgcgaaagaccctcaactcgaacattttctcgggtaacaggttggatgccaatcagcacttgagatcccgaaaggtcgaagagttaatcgcttactgccgaaagaactgtcagacaggcgaggccgtcgacgtcggccgggcagccttccggacatcgttgaacttgctctccaacctcatcttctccaaggatctgaccgatccttattcggattcagctaaggaattcaaggacctcgtctggaatatcatggtcgaggctggaaagccaaacttggtcgattattttcccgtactcgagaaagtcgaccctcagggcatcagacgacgaatgactgtccatttcggaaaagttctcaagctgttcgacggtcttgtgaatgagcgactagagcagcgtcgtagccgaggaggaaagaatgatgtgttggacgtgctgcttactaactcagaggagaaccccgaggagattgatcgaacgcacattgagcggatgtgcttggacctattcgttgcaggtactgatacgacttcatctactcttgagtgggccatggccgagatgctgaagaaccctgataagatgaagaagacgcaggccgagctagctgaggtgatcggcagaggtaaggcgattgaggagagcgacctccctcgactgccttaccttcgatgtgttgtgaaagaaaccctgcgaattcaccctccggtccccttcctgattcccaggcgagtcgagcaagacgttgaggtgtgtggctataaggtccctaagggatctcaagtcctggtcaacgcgtggacaatcgggcgagacgaggccgtctgggaggacgctctagcttttaagcccgaacggttcctcgagtccgagctggacattagaggacgagatttcgagttgattccattcggagctggtcgtagaatttgccctggtctacccctcgccttgcggacagtccctctcatggtcggctctctgctcaactcgttcaattggaagctggagggcggaatcacccctaaggacctggacatggaagaaaagttcggcataaccctgcagaaggcacatcctctgagagccgtgcctatccctttcggtggcggctctggcggaagcacatctagcggtagttccggtggttggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1437 - DNA, 3462 bp, Artificial Sequence
  source: /note="Description of Artificial Sequence: Synthetic polynucleotide"
atggattaccttacaattactttgggactcctcttcgccctcaccttctatcagggactgtcctacctgtcacgacgatctaaaaagctcccccctggaccggctccccttcccatcatcgggaacctccacatgctgggggatcagccccataagtctctggccaagctctcaaagaagcatggtccgatcatgtctcttaagctgggacaaatcaccacagttgtggtgtcttcttctggaatggctaaggaagtcctgcagaaacacgacttggcctttagtagtcgatctattcctaacgccctgcacgctcataaccagtatcagttcagcgtcgtttggctccccgtcgcttcccgttggcgatcgctgcgaaagaccctcaactcgaacattttctcgggtaacaggttggatgccaatcagcacttgagatcccgaaaggtcgaagagttaatcgcttactgccgaaagaactgtcagacaggcgaggccgtcgacgtcggccgggcagccttccggacatcgttgaacttgctctccaacctcatcttctccaaggatctgaccgatccttattcggattcagctaaggaattcaaggacctcgtctggaatatcatggtcgaggctggaaagccaaacttggtcgattattttcccgtactcgagaaagtcgaccctcagggcatcagacgacgaatgactgtccatttcggaaaagttctcaagctgttcgacggtcttgtgaatgagcgactagagcagcgtcgtagccgaggaggaaagaatgatgtgttggacgtgctgcttactaactcagaggagaaccccgaggagattgatcgaacgcacattgagcggatgtgcttggacctattcgttgcaggtactgatacgacttcatctactcttgagtgggccatggccgagatgctgaagaaccctgataagatgaagaagacgcaggccgagctagctgaggtgatcggcagaggtaaggcgattgaggagagcgacctccctcgactgccttaccttcgatgtgttgtgaaagaaaccctgcgaattcaccctccggtccccttcctgattcccaggcgagtcgagcaagacgttgaggtgtgtggctataaggtccctaagggatctcaagtcctggtcaacgcgtggacaatcgggcgagacgaggccgtctgggaggacgctctagcttttaagcccgaacggttcctcgagtccgagctggacattagaggacgagatttcgagttgattccattcggagctggtcgtagaatttgccctggtctacccctcgccttgcggacagtccctctcatggtcggctctctgctcaactcgttcaattggaagctggagggcggaatcacccctaaggacctggacatggaagaaaagttcggcataaccctgcagaaggcacatcctctgagagccgtgcctatccctttcggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1438 - DNA, 3450 bp, Artificial Sequence
  source: /note="Description of Artificial Sequence: Synthetic polynucleotide"
atggactacctcaccctggtcctcggcctgcttttcgccctcacattctaccagggcctcagctacctgtcccgaaagagtaagaaactcccccctggtcccgcaccgcttccttttatcggaaacctccacctgttgggtgaccagccccataagtctctggctaagctctctaagaagcatggccctctaatgagtctcaagttgggacacatcaccacggtcgtcatttcctcttctggaatggcgaaagaagttctccagaaacaggatctagcattttcttcacgttcggtccctgacgctttgcatgctcataaccaattccagttttcagtggtttggctgcctgttgcctcccgatggaggtccctgcgcaagattctgaactctaacatcttttcaggaaaccgcctggatgcaaaccagcacctgcgatgccgcaaggtccaggaattaatcgcctattgccgaaaaaactgccagactggcgaggccgttgatgtgggacgagccgcctttcgaacctcgcttaacctcctctccaacaccattttctcaaaggatctgaccgatccgtactcagactctgccaaggagtttaaggacttggtctggaacattatggtcgaggcaggtaagcccaatctggtggactttttccctgtcctcgagaaggtggacccccagggaatccgaaagagaatgaccgtacacttcggtaaggtccttaagctgtttaatggattgattaacgagagactggaacagaagagactccagtcaggtaacaacgatgtgttggacgtactgctgacaacttctgaagaatctcctgaggagatcgatcggacccatatcgagagaatgtgccttgatctgtttgtggctgggactgacaccacatcatccacgctagagtgggcaatggcagaaatgttaaagaaccctgacaaaatgcagaagactcaggccgagatcgccgaggtaattggaaaggggaaggctatcgaggaggccgatgttgcccgattgccctaccttcgatgtgttgtgaaagagaccctgagaatccaccctcccgtgcctttcctgattcctcgaaaggtcgaccaagacgtcgaggtgtgtggatacaaggtccctaaaggctcccaggttctcgtcaacgcctgggccatcggacgagatggaactgtttgggaggatccactcgcgttcaagccggagcgttttttcgaatcagaaatcgacattagaggcagggactttgaggtcatcccatttggagcaggccggcgcatttgtcctggcctgcctttagcagctcgaatggtgcccgtcatgctgggctctctgctgaactcgtttaactggaagctggagggaggcatcgcccccaaggatcttgacatggatgagaagttcggcattaccttgcagaaggctcatccactcagagctgtcccttcccctctaggtggcggctctggcggaagcacatctagcggtagttccggtggttggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1439 - DNA, 3462 bp, Artificial Sequence
  source: /note="Description of Artificial Sequence: Synthetic polynucleotide"
atggactacctcaccctggtcctcggcctgcttttcgccctcacattctaccagggcctcagctacctgtcccgaaagagtaagaaactcccccctggtcccgcaccgcttccttttatcggaaacctccacctgttgggtgaccagccccataagtctctggctaagctctctaagaagcatggccctctaatgagtctcaagttgggacacatcaccacggtcgtcatttcctcttctggaatggcgaaagaagttctccagaaacaggatctagcattttcttcacgttcggtccctgacgctttgcatgctcataaccaattccagttttcagtggtttggctgcctgttgcctcccgatggaggtccctgcgcaagattctgaactctaacatcttttcaggaaaccgcctggatgcaaaccagcacctgcgatgccgcaaggtccaggaattaatcgcctattgccgaaaaaactgccagactggcgaggccgttgatgtgggacgagccgcctttcgaacctcgcttaacctcctctccaacaccattttctcaaaggatctgaccgatccgtactcagactctgccaaggagtttaaggacttggtctggaacattatggtcgaggcaggtaagcccaatctggtggactttttccctgtcctcgagaaggtggacccccagggaatccgaaagagaatgaccgtacacttcggtaaggtccttaagctgtttaatggattgattaacgagagactggaacagaagagactccagtcaggtaacaacgatgtgttggacgtactgctgacaacttctgaagaatctcctgaggagatcgatcggacccatatcgagagaatgtgccttgatctgtttgtggctgggactgacaccacatcatccacgctagagtgggcaatggcagaaatgttaaagaaccctgacaaaatgcagaagactcaggccgagatcgccgaggtaattggaaaggggaaggctatcgaggaggccgatgttgcccgattgccctaccttcgatgtgttgtgaaagagaccctgagaatccaccctcccgtgcctttcctgattcctcgaaaggtcgaccaagacgtcgaggtgtgtggatacaaggtccctaaaggctcccaggttctcgtcaacgcctgggccatcggacgagatggaactgtttgggaggatccactcgcgttcaagccggagcgttttttcgaatcagaaatcgacattagaggcagggactttgaggtcatcccatttggagcaggccggcgcatttgtcctggcctgcctttagcagctcgaatggtgcccgtcatgctgggctctctgctgaactcgtttaactggaagctggagggaggcatcgcccccaaggatcttgacatggatgagaagttcggcattaccttgcagaaggctcatccactcagagctgtcccttcccctctaggtggcggctctggcggaagcacatctagcggtagttccggtggttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1440 - DNA, 3462 bp, Artificial Sequence
  source: /note="Description of Artificial Sequence: Synthetic polynucleotide"
atggactacctcaccctggtcctcggcctgcttttcgccctcacattctaccagggcctcagctacctgtcccgaaagagtaagaaactcccccctggtcccgcaccgcttccttttatcggaaacctccacctgttgggtgaccagccccataagtctctggctaagctctctaagaagcatggccctctaatgagtctcaagttgggacacatcaccacggtcgtcatttcctcttctggaatggcgaaagaagttctccagaaacaggatctagcattttcttcacgttcggtccctgacgctttgcatgctcataaccaattccagttttcagtggtttggctgcctgttgcctcccgatggaggtccctgcgcaagattctgaactctaacatcttttcaggaaaccgcctggatgcaaaccagcacctgcgatgccgcaaggtccaggaattaatcgcctattgccgaaaaaactgccagactggcgaggccgttgatgtgggacgagccgcctttcgaacctcgcttaacctcctctccaacaccattttctcaaaggatctgaccgatccgtactcagactctgccaaggagtttaaggacttggtctggaacattatggtcgaggcaggtaagcccaatctggtggactttttccctgtcctcgagaaggtggacccccagggaatccgaaagagaatgaccgtacacttcggtaaggtccttaagctgtttaatggattgattaacgagagactggaacagaagagactccagtcaggtaacaacgatgtgttggacgtactgctgacaacttctgaagaatctcctgaggagatcgatcggacccatatcgagagaatgtgccttgatctgtttgtggctgggactgacaccacatcatccacgctagagtgggcaatggcagaaatgttaaagaaccctgacaaaatgcagaagactcaggccgagatcgccgaggtaattggaaaggggaaggctatcgaggaggccgatgttgcccgattgccctaccttcgatgtgttgtgaaagagaccctgagaatccaccctcccgtgcctttcctgattcctcgaaaggtcgaccaagacgtcgaggtgtgtggatacaaggtccctaaaggctcccaggttctcgtcaacgcctgggccatcggacgagatggaactgtttgggaggatccactcgcgttcaagccggagcgttttttcgaatcagaaatcgacattagaggcagggactttgaggtcatcccatttggagcaggccggcgcatttgtcctggcctgcctttagcagctcgaatggtgcccgtcatgctgggctctctgctgaactcgtttaactggaagctggagggaggcatcgcccccaaggatcttgacatggatgagaagttcggcattaccttgcagaaggctcatccactcagagctgtcccttcccctctaggtggcggctctggcggaagcacatctagcggtagttccggtggttggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1441 - DNA, 3462 bp, Artificial Sequence
  source: /note="Description of Artificial Sequence: Synthetic polynucleotide"
atggactacctcaccctggtcctcggcctgcttttcgccctcacattctaccagggcctcagctacctgtcccgaaagagtaagaaactcccccctggtcccgcaccgcttccttttatcggaaacctccacctgttgggtgaccagccccataagtctctggctaagctctctaagaagcatggccctctaatgagtctcaagttgggacacatcaccacggtcgtcatttcctcttctggaatggcgaaagaagttctccagaaacaggatctagcattttcttcacgttcggtccctgacgctttgcatgctcataaccaattccagttttcagtggtttggctgcctgttgcctcccgatggaggtccctgcgcaagattctgaactctaacatcttttcaggaaaccgcctggatgcaaaccagcacctgcgatgccgcaaggtccaggaattaatcgcctattgccgaaaaaactgccagactggcgaggccgttgatgtgggacgagccgcctttcgaacctcgcttaacctcctctccaacaccattttctcaaaggatctgaccgatccgtactcagactctgccaaggagtttaaggacttggtctggaacattatggtcgaggcaggtaagcccaatctggtggactttttccctgtcctcgagaaggtggacccccagggaatccgaaagagaatgaccgtacacttcggtaaggtccttaagctgtttaatggattgattaacgagagactggaacagaagagactccagtcaggtaacaacgatgtgttggacgtactgctgacaacttctgaagaatctcctgaggagatcgatcggacccatatcgagagaatgtgccttgatctgtttgtggctgggactgacaccacatcatccacgctagagtgggcaatggcagaaatgttaaagaaccctgacaaaatgcagaagactcaggccgagatcgccgaggtaattggaaaggggaaggctatcgaggaggccgatgttgcccgattgccctaccttcgatgtgttgtgaaagagaccctgagaatccaccctcccgtgcctttcctgattcctcgaaaggtcgaccaagacgtcgaggtgtgtggatacaaggtccctaaaggctcccaggttctcgtcaacgcctgggccatcggacgagatggaactgtttgggaggatccactcgcgttcaagccggagcgttttttcgaatcagaaatcgacattagaggcagggactttgaggtcatcccatttggagcaggccggcgcatttgtcctggcctgcctttagcagctcgaatggtgcccgtcatgctgggctctctgctgaactcgtttaactggaagctggagggaggcatcgcccccaaggatcttgacatggatgagaagttcggcattaccttgcagaaggctcatccactcagagctgtcccttcccctctaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1442 - DNA, 3450 bp, Artificial Sequence
  source: /note="Description of Artificial Sequence: Synthetic polynucleotide"
atggattatttaacaattattctgacacttttgtttgcattaaccttgtatgaggcctttagctaccttagcaggcgtacaaagaatcttccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctactttaggtggcggctctggcggaagcacatctagcggtagttccggtggttggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1443 - DNA, 3462 bp, Artificial Sequence
  source: /note="Description of Artificial Sequence: Synthetic polynucleotide"
atggattatttaacaattattctgacacttttgtttgcattaaccttgtatgaggcctttagctaccttagcaggcgtacaaagaatcttccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctactttaggtggcggctctggcggaagcacatctagcggtagttccggtggttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1444 - DNA, 3462 bp, Artificial Sequence
  source: /note="Description of Artificial Sequence: Synthetic polynucleotide"
atggattatttaacaattattctgacacttttgtttgcattaaccttgtatgaggcctttagctaccttagcaggcgtacaaagaatcttccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctactttaggtggcggctctggcggaagcacatctagcggtagttccggtggttggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1445 - DNA, 3462 bp, Artificial Sequence
  source: /note="Description of Artificial Sequence: Synthetic polynucleotide"
atggattatttaacaattattctgacacttttgtttgcattaaccttgtatgaggcctttagctaccttagcaggcgtacaaagaatcttccccctggtccatccccattaccattcataggttctctgcatttgttgggtgatcaaccgcataaatcgctcgctaaactaagcaaaaagcacggccctataatgtccttgaaactgggtcaaattaccaccattgtaatatcatcctctaccatggccaaagaagtactacagaagcaagacttggcattctcttctcgatcagtacctaacgctttgcatgcccataatcaatttaaatttagtgtagtgtggctaccagtagcatctaggtggagatcattgagaaaggtattaaatagcaacatcttttctggtaaccgcttggatgccaaccagcatctcaggactcgaaaggtgcaagaattgatagcgtactgtagaaaaaattctcaatctggagaggctgtggacgtcggtagggcggctttccggacatcgttgaatttgttgtccaacctaattttctcgaaagatttgacagatccatactccgatagcgctaaagaatttaaagatttggtatggaatattatggttgaagccggaaaacctaacttagtggatttttttccgttattagaaaaagtcgatccacagggtattagacatagaatgactatacactttggtgaagtactgaaactgttcggtgggttggtaaatgaaaggttagagcaaagaagatctaaaggtgaaaaaaacgacgtattagatgtattgctaactactagtcaagaaagtcccgaggaaattgatcgaacgcatattgaacgtatgtgtttggatttgttcgtggctggtactgacacgacctcatctaccttggaatgggctatgtcagaaatgcttaaaaacccggataaaatgaagaaaacccaggacgaactagctcaagtgataggtcgaggtaaaacaatagaggaaagtgacatcaacagattgccttatttaagatgtgttatgaaggaaaccctgagaattcatcctcctgttccctttttgatacctcgcaaggttgagcaatctgtagaagtttgcggttataatgtgccaaagggatctcaagtactagtcaacgcatgggcaattgggcgagatgagaccgtttgggatgacgctttagcattcaagcctgaaagatttatggaaagcgaattggacataaggggcagagattttgagttaatcccttttggtgctggcagacgtatatgtccgggccttcctctcgcgttgagaactgttccattgatgttgggttcattacttaactctttcaattggaaacttgaaggaggtatggccccaaaagatttggacatggaagaaaaatttggtataacgttgcaaaaagcgcatcctctaagagcggtcccatctactttaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1446 - DNA, 3447 bp, Artificial Sequence
  source: /note="Description of Artificial Sequence: Synthetic polynucleotide"
atggattttttgactattttcattggcccattattagcaataattgcactattttacgccaggttaaccattagcactcggggtaagaatttaccaccaggtcctactccactaccttttattggtaatttacatttgctaggtcatcacccacataagtctttggcgagacttgctaaaacttatggaccgttgatgctgctaagattagggtctgaaaatactgtagtagtgagttctgcagccgttgcaaaggaggtattacaaaagcatgatttagctttttcatctagatccataccagatgcggttcatgctcacgatcagttcaaatactctgtcgtctggttacctgtggcatctcggtggcgatcacttagaaaaactatgaattcgaatattttcagcggttcatgcttagatgctaatcaacatttgcgaagtagaaaagttgaagaattgatagcgtattgcaaagaaagttgccgtcgagctgaggctgtcgatgttggaagagctgcattcagaactgctttgaactccctgtccaacaccattttctcgagggatctggcagatcctctgtccgactctggaaaagaatttaaggatgttgtatcttccataatgatggaagcaggcaaacctaacagtgtagactattacccctttctatccagattcgatccccagggaataagaagacgtactgccatttattttgataaattaataaatattttcaaagggttgattgacgagagattggaaaaacgtaggagtcagtacgaggaagcgacagacgtcattgacatacttttgaacacaatcgaacaaaacccggaggaaatcgaccgtactcatattgaaaggatgtttttggacctatttcttgccggtacagatacgaccagtagtacggtcgagtgggccatggctgaggccatgaagaacccggaaactatgaaaaaagctaaagctgagctggcacaggtaattggcaaaggtaaaattgtacaagaaactgatatcccacatttgccatatttgcaatgtattgtgaaggaaactcttcgcttacatccgccggtcccatttcttatacctcgacgcgtacatgaagatgttgacatcttgggttatgttgttcctaataactcacaagtattcgtcaacatgtgggccattggccgcgatccagatatgtggaagaatccactacaatttgatcctgatagattccatgattcagaagtgggtctaagaggtaaagacttcgaacttataccatttggtgctgggcgtagaatctgcccaggattacctttagcaatgagaatggttccagttgttttgggctcactattgaattcatttgattggaaagtcgaaggcggcaaggaattggaaatgaacgaaaagtttggtatcacattggaaaaggcacaacccttgatggcggtaccaattgcactaggtggcggctctggcggaagcacatctagcggtagttccggtggttggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1447 - DNA, 3459 bp, Artificial Sequence
  source: /note="Description of Artificial Sequence: Synthetic polynucleotide"
atggattttttgactattttcattggcccattattagcaataattgcactattttacgccaggttaaccattagcactcggggtaagaatttaccaccaggtcctactccactaccttttattggtaatttacatttgctaggtcatcacccacataagtctttggcgagacttgctaaaacttatggaccgttgatgctgctaagattagggtctgaaaatactgtagtagtgagttctgcagccgttgcaaaggaggtattacaaaagcatgatttagctttttcatctagatccataccagatgcggttcatgctcacgatcagttcaaatactctgtcgtctggttacctgtggcatctcggtggcgatcacttagaaaaactatgaattcgaatattttcagcggttcatgcttagatgctaatcaacatttgcgaagtagaaaagttgaagaattgatagcgtattgcaaagaaagttgccgtcgagctgaggctgtcgatgttggaagagctgcattcagaactgctttgaactccctgtccaacaccattttctcgagggatctggcagatcctctgtccgactctggaaaagaatttaaggatgttgtatcttccataatgatggaagcaggcaaacctaacagtgtagactattacccctttctatccagattcgatccccagggaataagaagacgtactgccatttattttgataaattaataaatattttcaaagggttgattgacgagagattggaaaaacgtaggagtcagtacgaggaagcgacagacgtcattgacatacttttgaacacaatcgaacaaaacccggaggaaatcgaccgtactcatattgaaaggatgtttttggacctatttcttgccggtacagatacgaccagtagtacggtcgagtgggccatggctgaggccatgaagaacccggaaactatgaaaaaagctaaagctgagctggcacaggtaattggcaaaggtaaaattgtacaagaaactgatatcccacatttgccatatttgcaatgtattgtgaaggaaactcttcgcttacatccgccggtcccatttcttatacctcgacgcgtacatgaagatgttgacatcttgggttatgttgttcctaataactcacaagtattcgtcaacatgtgggccattggccgcgatccagatatgtggaagaatccactacaatttgatcctgatagattccatgattcagaagtgggtctaagaggtaaagacttcgaacttataccatttggtgctgggcgtagaatctgcccaggattacctttagcaatgagaatggttccagttgttttgggctcactattgaattcatttgattggaaagtcgaaggcggcaaggaattggaaatgaacgaaaagtttggtatcacattggaaaaggcacaacccttgatggcggtaccaattgcactaggtggcggctctggcggaagcacatctagcggtagttccggtggttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1448 - DNA, 3459 bp, Artificial Sequence
  source: /note="Description of Artificial Sequence: Synthetic polynucleotide"
atggattttttgactattttcattggcccattattagcaataattgcactattttacgccaggttaaccattagcactcggggtaagaatttaccaccaggtcctactccactaccttttattggtaatttacatttgctaggtcatcacccacataagtctttggcgagacttgctaaaacttatggaccgttgatgctgctaagattagggtctgaaaatactgtagtagtgagttctgcagccgttgcaaaggaggtattacaaaagcatgatttagctttttcatctagatccataccagatgcggttcatgctcacgatcagttcaaatactctgtcgtctggttacctgtggcatctcggtggcgatcacttagaaaaactatgaattcgaatattttcagcggttcatgcttagatgctaatcaacatttgcgaagtagaaaagttgaagaattgatagcgtattgcaaagaaagttgccgtcgagctgaggctgtcgatgttggaagagctgcattcagaactgctttgaactccctgtccaacaccattttctcgagggatctggcagatcctctgtccgactctggaaaagaatttaaggatgttgtatcttccataatgatggaagcaggcaaacctaacagtgtagactattacccctttctatccagattcgatccccagggaataagaagacgtactgccatttattttgataaattaataaatattttcaaagggttgattgacgagagattggaaaaacgtaggagtcagtacgaggaagcgacagacgtcattgacatacttttgaacacaatcgaacaaaacccggaggaaatcgaccgtactcatattgaaaggatgtttttggacctatttcttgccggtacagatacgaccagtagtacggtcgagtgggccatggctgaggccatgaagaacccggaaactatgaaaaaagctaaagctgagctggcacaggtaattggcaaaggtaaaattgtacaagaaactgatatcccacatttgccatatttgcaatgtattgtgaaggaaactcttcgcttacatccgccggtcccatttcttatacctcgacgcgtacatgaagatgttgacatcttgggttatgttgttcctaataactcacaagtattcgtcaacatgtgggccattggccgcgatccagatatgtggaagaatccactacaatttgatcctgatagattccatgattcagaagtgggtctaagaggtaaagacttcgaacttataccatttggtgctgggcgtagaatctgcccaggattacctttagcaatgagaatggttccagttgttttgggctcactattgaattcatttgattggaaagtcgaaggcggcaaggaattggaaatgaacgaaaagtttggtatcacattggaaaaggcacaacccttgatggcggtaccaattgcactaggtggcggctctggcggaagcacatctagcggtagttccggtggttggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1449 - DNA, 3459 bp, Artificial Sequence
  source: /note="Description of Artificial Sequence: Synthetic polynucleotide"
atggattttttgactattttcattggcccattattagcaataattgcactattttacgccaggttaaccattagcactcggggtaagaatttaccaccaggtcctactccactaccttttattggtaatttacatttgctaggtcatcacccacataagtctttggcgagacttgctaaaacttatggaccgttgatgctgctaagattagggtctgaaaatactgtagtagtgagttctgcagccgttgcaaaggaggtattacaaaagcatgatttagctttttcatctagatccataccagatgcggttcatgctcacgatcagttcaaatactctgtcgtctggttacctgtggcatctcggtggcgatcacttagaaaaactatgaattcgaatattttcagcggttcatgcttagatgctaatcaacatttgcgaagtagaaaagttgaagaattgatagcgtattgcaaagaaagttgccgtcgagctgaggctgtcgatgttggaagagctgcattcagaactgctttgaactccctgtccaacaccattttctcgagggatctggcagatcctctgtccgactctggaaaagaatttaaggatgttgtatcttccataatgatggaagcaggcaaacctaacagtgtagactattacccctttctatccagattcgatccccagggaataagaagacgtactgccatttattttgataaattaataaatattttcaaagggttgattgacgagagattggaaaaacgtaggagtcagtacgaggaagcgacagacgtcattgacatacttttgaacacaatcgaacaaaacccggaggaaatcgaccgtactcatattgaaaggatgtttttggacctatttcttgccggtacagatacgaccagtagtacggtcgagtgggccatggctgaggccatgaagaacccggaaactatgaaaaaagctaaagctgagctggcacaggtaattggcaaaggtaaaattgtacaagaaactgatatcccacatttgccatatttgcaatgtattgtgaaggaaactcttcgcttacatccgccggtcccatttcttatacctcgacgcgtacatgaagatgttgacatcttgggttatgttgttcctaataactcacaagtattcgtcaacatgtgggccattggccgcgatccagatatgtggaagaatccactacaatttgatcctgatagattccatgattcagaagtgggtctaagaggtaaagacttcgaacttataccatttggtgctgggcgtagaatctgcccaggattacctttagcaatgagaatggttccagttgttttgggctcactattgaattcatttgattggaaagtcgaaggcggcaaggaattggaaatgaacgaaaagtttggtatcacattggaaaaggcacaacccttgatggcggtaccaattgcactaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1450 - DNA, 3465 bp, Artificial Sequence
  source: /note="Description of Artificial Sequence: Synthetic polynucleotide"
atggacttcttttcgttcttgctgtattttttgtttactctgagtttagtacaagctactatttcactggttcgcggttctaagcataaaggacgaaaattgccaccgggtcctgcaccattgcctatagtaggtaacctactaaaactgggagatcaaccacacaagagtctggccgatttggctaaaatccatggtccaataatgaccctcaagcttggacatataaccactgtcataatttcctcttcagatttagctaaagaggtattgcaaaagcaggatcttgctttctcatcccgttctattccagacgccattagagcccataatcaatttcaatattcagttgtctggttgcctgtggcaaatcaatggaggtcgttgagaaagattcttaattctaatatttttagcgggaatcgtttggacgccaaccaacacttaaggtggagaaaggtgcaagaattgatcgcttacgtgcgcaaatcatctcaagttggcgacgctgtcgatattggtcgcgccgcattcagaacgtcattgaatttgttgtctaacacgatcttcagtgtcgatctggcggatcctaataacgactctgctaaagaatttaaagacttagtgtctaacatcatggttgaggctggtaagcctaaccttgtggattacttccctgttctggaaaagatagatcctcaaggcatcagaagaagaatgacaatccactttgggaaagtattagaaatgttcggaagattaatcaatgaaagattagaattccgtcgtctacgttcatccgtcatttctaacgacgtattggatgtcttactgaacactgaagagtctggtaacgagatcgatagaaaccatattgagcgtatgtgtcttgatttgttcgttgctggcactgacacaacaagctcgactttagaatgggctatggcggaagttttgcataaccccgaaacattggtcaaggctaaggctgagttagaacaaattattggtagaggtaaggcgatcgaagagagcgacatatctaacttgccataccttcgttcaattatcaaagaaactttgcgtttgcatccaccagtcccatttctgatacctagaaaagttgaagtggattccgaggtcagcggttatactgtgcctaagggttcccaggtattggtcaacgcttgggctataggtcgagatccctgctgttgggaaaatccattgaatttttccccagaaagatttttgaattcagagttagatgttagagggagagattttgaattgatcccattcggtgctggtcggaggatttgccctggtttaccattggccattagaatggtaccagtcatgctagggtcgttattgaactccttcgattggaagcttgatggtgggattaaaccagaagaactcgacatggaagagaaattcggcattactttgcagaaagctcaacccttacgggctgtccccacgttagtaggtggcggctctggcggaagcacatctagcggtagttccggtggttggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1451 - DNA, 3477 bp, Artificial Sequence
  source: /note="Description of Artificial Sequence: Synthetic polynucleotide"
atggacttcttttcgttcttgctgtattttttgtttactctgagtttagtacaagctactatttcactggttcgcggttctaagcataaaggacgaaaattgccaccgggtcctgcaccattgcctatagtaggtaacctactaaaactgggagatcaaccacacaagagtctggccgatttggctaaaatccatggtccaataatgaccctcaagcttggacatataaccactgtcataatttcctcttcagatttagctaaagaggtattgcaaaagcaggatcttgctttctcatcccgttctattccagacgccattagagcccataatcaatttcaatattcagttgtctggttgcctgtggcaaatcaatggaggtcgttgagaaagattcttaattctaatatttttagcgggaatcgtttggacgccaaccaacacttaaggtggagaaaggtgcaagaattgatcgcttacgtgcgcaaatcatctcaagttggcgacgctgtcgatattggtcgcgccgcattcagaacgtcattgaatttgttgtctaacacgatcttcagtgtcgatctggcggatcctaataacgactctgctaaagaatttaaagacttagtgtctaacatcatggttgaggctggtaagcctaaccttgtggattacttccctgttctggaaaagatagatcctcaaggcatcagaagaagaatgacaatccactttgggaaagtattagaaatgttcggaagattaatcaatgaaagattagaattccgtcgtctacgttcatccgtcatttctaacgacgtattggatgtcttactgaacactgaagagtctggtaacgagatcgatagaaaccatattgagcgtatgtgtcttgatttgttcgttgctggcactgacacaacaagctcgactttagaatgggctatggcggaagttttgcataaccccgaaacattggtcaaggctaaggctgagttagaacaaattattggtagaggtaaggcgatcgaagagagcgacatatctaacttgccataccttcgttcaattatcaaagaaactttgcgtttgcatccaccagtcccatttctgatacctagaaaagttgaagtggattccgaggtcagcggttatactgtgcctaagggttcccaggtattggtcaacgcttgggctataggtcgagatccctgctgttgggaaaatccattgaatttttccccagaaagatttttgaattcagagttagatgttagagggagagattttgaattgatcccattcggtgctggtcggaggatttgccctggtttaccattggccattagaatggtaccagtcatgctagggtcgttattgaactccttcgattggaagcttgatggtgggattaaaccagaagaactcgacatggaagagaaattcggcattactttgcagaaagctcaacccttacgggctgtccccacgttagtaggtggcggctctggcggaagcacatctagcggtagttccggtggttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1452 - DNA, 3477 bp, Artificial Sequence
  source: /note="Description of Artificial Sequence: Synthetic polynucleotide"
atggacttcttttcgttcttgctgtattttttgtttactctgagtttagtacaagctactatttcactggttcgcggttctaagcataaaggacgaaaattgccaccgggtcctgcaccattgcctatagtaggtaacctactaaaactgggagatcaaccacacaagagtctggccgatttggctaaaatccatggtccaataatgaccctcaagcttggacatataaccactgtcataatttcctcttcagatttagctaaagaggtattgcaaaagcaggatcttgctttctcatcccgttctattccagacgccattagagcccataatcaatttcaatattcagttgtctggttgcctgtggcaaatcaatggaggtcgttgagaaagattcttaattctaatatttttagcgggaatcgtttggacgccaaccaacacttaaggtggagaaaggtgcaagaattgatcgcttacgtgcgcaaatcatctcaagttggcgacgctgtcgatattggtcgcgccgcattcagaacgtcattgaatttgttgtctaacacgatcttcagtgtcgatctggcggatcctaataacgactctgctaaagaatttaaagacttagtgtctaacatcatggttgaggctggtaagcctaaccttgtggattacttccctgttctggaaaagatagatcctcaaggcatcagaagaagaatgacaatccactttgggaaagtattagaaatgttcggaagattaatcaatgaaagattagaattccgtcgtctacgttcatccgtcatttctaacgacgtattggatgtcttactgaacactgaagagtctggtaacgagatcgatagaaaccatattgagcgtatgtgtcttgatttgttcgttgctggcactgacacaacaagctcgactttagaatgggctatggcggaagttttgcataaccccgaaacattggtcaaggctaaggctgagttagaacaaattattggtagaggtaaggcgatcgaagagagcgacatatctaacttgccataccttcgttcaattatcaaagaaactttgcgtttgcatccaccagtcccatttctgatacctagaaaagttgaagtggattccgaggtcagcggttatactgtgcctaagggttcccaggtattggtcaacgcttgggctataggtcgagatccctgctgttgggaaaatccattgaatttttccccagaaagatttttgaattcagagttagatgttagagggagagattttgaattgatcccattcggtgctggtcggaggatttgccctggtttaccattggccattagaatggtaccagtcatgctagggtcgttattgaactccttcgattggaagcttgatggtgggattaaaccagaagaactcgacatggaagagaaattcggcattactttgcagaaagctcaacccttacgggctgtccccacgttagtaggtggcggctctggcggaagcacatctagcggtagttccggtggttggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1453 - DNA, 3477 bp, Artificial Sequence
  source: /note="Description of Artificial Sequence: Synthetic polynucleotide"
atggacttcttttcgttcttgctgtattttttgtttactctgagtttagtacaagctactatttcactggttcgcggttctaagcataaaggacgaaaattgccaccgggtcctgcaccattgcctatagtaggtaacctactaaaactgggagatcaaccacacaagagtctggccgatttggctaaaatccatggtccaataatgaccctcaagcttggacatataaccactgtcataatttcctcttcagatttagctaaagaggtattgcaaaagcaggatcttgctttctcatcccgttctattccagacgccattagagcccataatcaatttcaatattcagttgtctggttgcctgtggcaaatcaatggaggtcgttgagaaagattcttaattctaatatttttagcgggaatcgtttggacgccaaccaacacttaaggtggagaaaggtgcaagaattgatcgcttacgtgcgcaaatcatctcaagttggcgacgctgtcgatattggtcgcgccgcattcagaacgtcattgaatttgttgtctaacacgatcttcagtgtcgatctggcggatcctaataacgactctgctaaagaatttaaagacttagtgtctaacatcatggttgaggctggtaagcctaaccttgtggattacttccctgttctggaaaagatagatcctcaaggcatcagaagaagaatgacaatccactttgggaaagtattagaaatgttcggaagattaatcaatgaaagattagaattccgtcgtctacgttcatccgtcatttctaacgacgtattggatgtcttactgaacactgaagagtctggtaacgagatcgatagaaaccatattgagcgtatgtgtcttgatttgttcgttgctggcactgacacaacaagctcgactttagaatgggctatggcggaagttttgcataaccccgaaacattggtcaaggctaaggctgagttagaacaaattattggtagaggtaaggcgatcgaagagagcgacatatctaacttgccataccttcgttcaattatcaaagaaactttgcgtttgcatccaccagtcccatttctgatacctagaaaagttgaagtggattccgaggtcagcggttatactgtgcctaagggttcccaggtattggtcaacgcttgggctataggtcgagatccctgctgttgggaaaatccattgaatttttccccagaaagatttttgaattcagagttagatgttagagggagagattttgaattgatcccattcggtgctggtcggaggatttgccctggtttaccattggccattagaatggtaccagtcatgctagggtcgttattgaactccttcgattggaagcttgatggtgggattaaaccagaagaactcgacatggaagagaaattcggcattactttgcagaaagctcaacccttacgggctgtccccacgttagtaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1454 - DNA, 3450 bp, Artificial Sequence
  source: /note="Description of Artificial Sequence: Synthetic polynucleotide"
atggattacttaaccatcgccttaggtttgcttttcgctttgactttttaccagggattgacctatctgtccaggcgttcacaaaagcttcctccaggtccgcttccccttcctatcataggcaatttgcatcttcttggggatcacccacacaaatctctagccaagctgtctaaaaaatacggccctataatgtcgttaaaactgggacgtatcacgaccttagtcatttcttcttcgacgacggcaaaggaggtcctacaaaaacaagatttggcattttcttcaaggtccgtaccgaatgcattgcatgctcacaaccaattccaatactcggtagtgtggttgcctgttgctagtagatggcgttcattgcgaaagattttgaactccaacatcttctcgggaaatcggttagatgcgaaccagcatctaagatgccgtaaggtggaggaattaatagcatactgtaggaaaaactgtcaatccggtgaagcggttgatttaggtagggctgctttcagaacatctctcaacctactttcgaatacgatcttttcaaaggaccttaccgatccttactcggattcggcaaaggagttcaaggatctagtttggaacatcatggtcgaagctggtaagcctaaccttgtagacttttttcctgttttggagaaggtcgatccacaaggtattcgtagacgtatgaccgtacactttggtaaagtcatccagctttttaatggtttaattaacgaacgactggataaaagaaaatcaagggggggatacaatgacgtcctggacgtcttattaacaaccacagaagaaaatcctgaagaaattgacagaacccacatcgaaagaatgtgtttggatttatttgtagcgggaacagacactacaagtagcactttggaatgggccatggccgagatgttgcggaaccccgagaaaatgaaaaaaactcaagaagaactggctgaagtcgttggtcgagggaaattgattgaagaaggagatgtgtcaagattgccatatcttagatgtgtcgtgaaggaaactctgagagttcatccaccagtcccgttcttgattcctagaaaggtagttcaagatgtggaagtgtgcggctacaaagtacctaaaggttcacaagttttagtcaacgcgtgggctatagggagagacgaaacgttttggaaagatgctttaggttttaaaccagagagatttctagagagtgaattggatacccgtggaagagatttcgaattaattccttttggtgcaggtagacggatttgtcccggccttcctttggctaaccgaatggtcccagtaatgttaggatccttgttaaattcgtttaattggaagttagaaggcggcatagcgcctaaagatctcgatatggaggagaaatttggtatcacattacaaaaagcccatccccttagggcagtgccatctcctttaggtggcggctctggcggaagcacatctagcggtagttccggtggttggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1455 - DNA, 3462 bp, Artificial Sequence
  source: /note="Description of Artificial Sequence: Synthetic polynucleotide"
atggattacttaaccatcgccttaggtttgcttttcgctttgactttttaccagggattgacctatctgtccaggcgttcacaaaagcttcctccaggtccgcttccccttcctatcataggcaatttgcatcttcttggggatcacccacacaaatctctagccaagctgtctaaaaaatacggccctataatgtcgttaaaactgggacgtatcacgaccttagtcatttcttcttcgacgacggcaaaggaggtcctacaaaaacaagatttggcattttcttcaaggtccgtaccgaatgcattgcatgctcacaaccaattccaatactcggtagtgtggttgcctgttgctagtagatggcgttcattgcgaaagattttgaactccaacatcttctcgggaaatcggttagatgcgaaccagcatctaagatgccgtaaggtggaggaattaatagcatactgtaggaaaaactgtcaatccggtgaagcggttgatttaggtagggctgctttcagaacatctctcaacctactttcgaatacgatcttttcaaaggaccttaccgatccttactcggattcggcaaaggagttcaaggatctagtttggaacatcatggtcgaagctggtaagcctaaccttgtagacttttttcctgttttggagaaggtcgatccacaaggtattcgtagacgtatgaccgtacactttggtaaagtcatccagctttttaatggtttaattaacgaacgactggataaaagaaaatcaagggggggatacaatgacgtcctggacgtcttattaacaaccacagaagaaaatcctgaagaaattgacagaacccacatcgaaagaatgtgtttggatttatttgtagcgggaacagacactacaagtagcactttggaatgggccatggccgagatgttgcggaaccccgagaaaatgaaaaaaactcaagaagaactggctgaagtcgttggtcgagggaaattgattgaagaaggagatgtgtcaagattgccatatcttagatgtgtcgtgaaggaaactctgagagttcatccaccagtcccgttcttgattcctagaaaggtagttcaagatgtggaagtgtgcggctacaaagtacctaaaggttcacaagttttagtcaacgcgtgggctatagggagagacgaaacgttttggaaagatgctttaggttttaaaccagagagatttctagagagtgaattggatacccgtggaagagatttcgaattaattccttttggtgcaggtagacggatttgtcccggccttcctttggctaaccgaatggtcccagtaatgttaggatccttgttaaattcgtttaattggaagttagaaggcggcatagcgcctaaagatctcgatatggaggagaaatttggtatcacattacaaaaagcccatccccttagggcagtgccatctcctttaggtggcggctctggcggaagcacatctagcggtagttccggtggttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1456 - DNA, 3462 bp, Artificial Sequence
  source: /note="Description of Artificial Sequence: Synthetic polynucleotide"
atggattacttaaccatcgccttaggtttgcttttcgctttgactttttaccagggattgacctatctgtccaggcgttcacaaaagcttcctccaggtccgcttccccttcctatcataggcaatttgcatcttcttggggatcacccacacaaatctctagccaagctgtctaaaaaatacggccctataatgtcgttaaaactgggacgtatcacgaccttagtcatttcttcttcgacgacggcaaaggaggtcctacaaaaacaagatttggcattttcttcaaggtccgtaccgaatgcattgcatgctcacaaccaattccaatactcggtagtgtggttgcctgttgctagtagatggcgttcattgcgaaagattttgaactccaacatcttctcgggaaatcggttagatgcgaaccagcatctaagatgccgtaaggtggaggaattaatagcatactgtaggaaaaactgtcaatccggtgaagcggttgatttaggtagggctgctttcagaacatctctcaacctactttcgaatacgatcttttcaaaggaccttaccgatccttactcggattcggcaaaggagttcaaggatctagtttggaacatcatggtcgaagctggtaagcctaaccttgtagacttttttcctgttttggagaaggtcgatccacaaggtattcgtagacgtatgaccgtacactttggtaaagtcatccagctttttaatggtttaattaacgaacgactggataaaagaaaatcaagggggggatacaatgacgtcctggacgtcttattaacaaccacagaagaaaatcctgaagaaattgacagaacccacatcgaaagaatgtgtttggatttatttgtagcgggaacagacactacaagtagcactttggaatgggccatggccgagatgttgcggaaccccgagaaaatgaaaaaaactcaagaagaactggctgaagtcgttggtcgagggaaattgattgaagaaggagatgtgtcaagattgccatatcttagatgtgtcgtgaaggaaactctgagagttcatccaccagtcccgttcttgattcctagaaaggtagttcaagatgtggaagtgtgcggctacaaagtacctaaaggttcacaagttttagtcaacgcgtgggctatagggagagacgaaacgttttggaaagatgctttaggttttaaaccagagagatttctagagagtgaattggatacccgtggaagagatttcgaattaattccttttggtgcaggtagacggatttgtcccggccttcctttggctaaccgaatggtcccagtaatgttaggatccttgttaaattcgtttaattggaagttagaaggcggcatagcgcctaaagatctcgatatggaggagaaatttggtatcacattacaaaaagcccatccccttagggcagtgccatctcctttaggtggcggctctggcggaagcacatctagcggtagttccggtggttggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1457 - DNA, 3462 bp, Artificial Sequence
  source: /note="Description of Artificial Sequence: Synthetic polynucleotide"
atggattacttaaccatcgccttaggtttgcttttcgctttgactttttaccagggattgacctatctgtccaggcgttcacaaaagcttcctccaggtccgcttccccttcctatcataggcaatttgcatcttcttggggatcacccacacaaatctctagccaagctgtctaaaaaatacggccctataatgtcgttaaaactgggacgtatcacgaccttagtcatttcttcttcgacgacggcaaaggaggtcctacaaaaacaagatttggcattttcttcaaggtccgtaccgaatgcattgcatgctcacaaccaattccaatactcggtagtgtggttgcctgttgctagtagatggcgttcattgcgaaagattttgaactccaacatcttctcgggaaatcggttagatgcgaaccagcatctaagatgccgtaaggtggaggaattaatagcatactgtaggaaaaactgtcaatccggtgaagcggttgatttaggtagggctgctttcagaacatctctcaacctactttcgaatacgatcttttcaaaggaccttaccgatccttactcggattcggcaaaggagttcaaggatctagtttggaacatcatggtcgaagctggtaagcctaaccttgtagacttttttcctgttttggagaaggtcgatccacaaggtattcgtagacgtatgaccgtacactttggtaaagtcatccagctttttaatggtttaattaacgaacgactggataaaagaaaatcaagggggggatacaatgacgtcctggacgtcttattaacaaccacagaagaaaatcctgaagaaattgacagaacccacatcgaaagaatgtgtttggatttatttgtagcgggaacagacactacaagtagcactttggaatgggccatggccgagatgttgcggaaccccgagaaaatgaaaaaaactcaagaagaactggctgaagtcgttggtcgagggaaattgattgaagaaggagatgtgtcaagattgccatatcttagatgtgtcgtgaaggaaactctgagagttcatccaccagtcccgttcttgattcctagaaaggtagttcaagatgtggaagtgtgcggctacaaagtacctaaaggttcacaagttttagtcaacgcgtgggctatagggagagacgaaacgttttggaaagatgctttaggttttaaaccagagagatttctagagagtgaattggatacccgtggaagagatttcgaattaattccttttggtgcaggtagacggatttgtcccggccttcctttggctaaccgaatggtcccagtaatgttaggatccttgttaaattcgtttaattggaagttagaaggcggcatagcgcctaaagatctcgatatggaggagaaatttggtatcacattacaaaaagcccatccccttagggcagtgccatctcctttaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1458 - DNA, 3465 bp, Artificial Sequence
  source: /note="Description of Artificial Sequence: Synthetic polynucleotide"
atggatttctttacaatcgcattgtcgttgttattcgcttttacgttatttaaagcaattatctcgctgacaaaatcgggtaaaaataaaaatcttcctcctggcccagcacccttacccatcatcggttctctgcataaattaggcgatcaaccccaccaaagcttggctaaattggctaagatatacggacctattatgagtctaaagttaggccggattaccactgtcgtgatttctagcagtgatgcagctaaagaagttctacaaaaaaaagatttagctttctcgtcgagacatgtcccagacgcattacatgctcacaatcaattcaaattttcagttgtctggttaccagtagcacctcaatggagatccttaaggaaaatcttgaactctaatatttttagcggtaaccggctagacgcaaatcaacaccttcgatgccggaaagtcgaagaactaatcacatactgcagaaaatcttcccattcaggagacgccgttgatataggtagagctgcttttcgtacaagtctaaatctattgtcaaatactattttcagtaaggatttaactgacccataccaagattctgccaaggagtttaaagaactagtaggtaacatcatggtagaagctggtaaacctaatttagttgatttttttccctctctaaaaaaaattgatcctcaagggatccgacatagaatgactattcattttggaaaggtcctggaactctttggaggactaattaatgaaagactagaattaaaatcatctcaaaaaagtgatgaaaaaaatgatgttctagacgtttgcttaagcattagcaaagagaaccctgatgagatcgacagaacacacatagaaaggatgtgtctcgacctgttcgttgccggtacggatactacatcatctacgttggaatgggctatggctgaagtcctaagaaatccagaaaccttggttaaagctaaagcggaattggaagaagttatcggcaagggtaagatcttggccgaagcagatgtatcgaacttgccatatctgaggtgtattgttaaggaaactcttagaatccatccgccagtaccattcctaattcctagaaaggtggaaatggatgtagaagcgtgtggttacactgtgcctaaaaatagtcaggtttttgttaatgtttgggcgataggaagagatcctactttatgggaagatcccctgagttttaaacctgaaagatttatggcatcggaattggacgtaaggggtcgtgacttcgagcttcttcctttcggagctggcaggagaatttgcccaggtctgccattggctatccgtatggttcccgtcatgctgggttctttagttaatagctttaactggaagttggatggtggtattgcccctaaggagttagatatgggtgagaaatttggtatcactttggcaaaagcacaaagtctcagagcagtcccatcaccactggtgggtggcggctctggcggaagcacatctagcggtagttccggtggttggaagaaaaccacagctgatcgctcaggcgagttaaaaccattaatgattcccaaatcactgatggcaaaggatgaagacgatgatttggacctagggtcaggtaagacaagggtgtccatcttctttggaactcaaacgggtactgctgaggggttcgcaaaggctctatcggaagaaataaaagctaggtacgaaaaagcagccgtcaaagacgattacgccgctgatgatgaccaatacgaagaaaaattgaaaaaagaaacattagccttcttctgcgtcgcaacttatggtgacggcgaaccaacagataatgcggctagattctacaaatggttcacggaagagaatgagagagatattaaattgcaacaactggcttacggtgtttttgcacttggaaacaggcagtacgaacattttaacaagattggaattgttttggatgaggagttgtgtaaaaagggagctaagagattgatagaagtgggcttgggagatgatgatcagtcaattgaggatgatttcaacgcatggaaggaaagcttgtggtctgagttggataagctccttaaggatgaagatgataaatcggtcgcgaccccttatactgctgtcataccggaatacagggtggtaactcatgaccctaggtttactacacagaagagtatggaatccaatgtggcgaatggtaacaccacaattgatatccatcatccatgtagagttgatgtggctgtccagaaagaattgcatacccatgaatcggacaggtcatgtattcatttggaattcgacatttcacgtacaggtattacttatgaaactggcgatcacgtgggcgtctacgctgagaatcacgtcgaaattgttgaggaagcaggaaaattgctgggacattcactagaccttgttttttcgatacatgcagataaggaagatggaagtccgttggaatctgcagtccctcctcctttcccaggaccatgtaccttgggtactggtttggccagatatgcagatctccttaatcctccccggaaaagcgcattggtggctttggctgcctatgcaactgaaccttcagaagctgaaaaacttaaacatctaacatccccagatggaaaggacgaatatagtcagtggatcgtggcgagtcaacgctcacttttagaagttatggcggcatttccaagcgctaaaccaccactgggtgttttctttgccgcaatagctcctagattacaacccagatattactctatctcatcctctccacgattagctccttctagagttcacgtcacttctgctttggtctacggtccaacgccaacaggtcgaattcataaaggtgtatgcagtacatggatgaagaatgctgttcctgctgagaaatcgcacgaatgttccggtgcccctatttttatcagagccagcaacttcaaattgccatctaatccgtctactcccattgttatggtaggtccgggtactggccttgccccgttcagaggttttttgcaagagcgaatggccttgaaggaagacggggaagagttaggttcttccctattatttttcggctgccggaatcgacaaatggactttatttatgaagatgaattgaacaactttgtggatcaaggagttatttccgaattgattatggcgttctctagagaaggtgcacaaaaagaatacgtccaacataaaatgatggaaaaggcagctcaagtatgggatctaattaaagaagaaggatatttatacgtatgtggggatgcaaaaggtatggccagagatgttcataggactttgcacactatcgtccaagaacaagaaggtgtctcatctagtgaagctgaagcgattgttaaaaaattacaaacagaaggcagatatttgagggatgtttgg

SEQ ID NO: 1459 - DNA, 3477 bp, Artificial Sequence
  source: /note="Description of Artificial Sequence: Synthetic polynucleotide"
atggatttctttacaatcgcattgtcgttgttattcgcttttacgttatttaaagcaattatctcgctgacaaaatcgggtaaaaataaaaatcttcctcctggcccagcacccttacccatcatcggttctctgcataaattaggcgatcaaccccaccaaagcttggctaaattggctaagatatacggacctattatgagtctaaagttaggccggattaccactgtcgtgatttctagcagtgatgcagctaaagaagttctacaaaaaaaagatttagctttctcgtcgagacatgtcccagacgcattacatgctcacaatcaattcaaattttcagttgtctggttaccagtagcacctcaatggagatccttaaggaaaatcttgaactctaatatttttagcggtaaccggctagacgcaaatcaacaccttcgatgccggaaagtcgaagaactaatcacatactgcagaaaatcttcccattcaggagacgccgttgatataggtagagctgcttttcgtacaagtctaaatctattgtcaaatactattttcagtaaggatttaactgacccataccaagattctgccaaggagtttaaagaactagtaggtaacatcatggtagaagctggtaaacctaatttagttgatttttttccctctctaaaaaaaattgatcctcaagggatccgacatagaatgactattcattttggaaaggtcctggaactctttggaggactaattaatgaaagactagaattaaaatcatctcaaaaaagtgatgaaaaaaatgatgttctagacgtttgcttaagcattagcaaagagaaccctgatgagatcgacagaacacacatagaaaggatgtgtctcgacctgttcgttgccggtacggatactacatcatctacgttggaatgggctatggctgaagtcctaagaaatccagaaaccttggttaaagctaaagcggaattggaagaagttatcggcaagggtaagatcttggccgaagcagatgtatcgaacttgccatatctgaggtgtattgttaaggaaactcttagaatccatccgccagtaccattcctaattcctagaaaggtggaaatggatgtagaagcgtgtggttacactgtgcctaaaaatagtcaggtttttgttaatgtttgggcgataggaagagatcctactttatgggaagatcccctgagttttaaacctgaaagatttatggcatcggaattggacgtaaggggtcgtgacttcgagcttcttcctttcggagctggcaggagaatttgcccaggtctgccattggctatccgtatggttcccgtcatgctgggttctttagttaatagctttaactggaagttggatggtggtattgcccctaaggagttagatatgggtgagaaatttggtatcactttggcaaaagcacaaagtctcagagcagtcccatcaccactggtgggtggcggctctggcggaagcacatctagcggtagttccggtggttggagacgctcgtcagatagatctaaagaaagcaacccagttgttgtacctagacctttactggtagaagctgaagaagatgaggtggaagtcggttctggaaaaacaaaattgacaattttctacggtacacagaccggtactgcggaaggtttcgctaaggctctagcagaagagatcaaggctcgttacgaaaaagccgttgtaaaagtcgtcgacctagatgactatgccgacgatgacgaacaatatgaggaaaagttgaaaaaggaaacgctggctttctttatggttgctacttatggggacggtgaaccgacagacaatgccgctagattctataagtggtttaccgacggcaaagaaagaggtttgtggttacagcaattgaaatttggtgtgtttggtctaggtaatagacagtatgagcattttaataagatagggaaggttttagaccaggatttaagtgaacaagggggtaaacgattgattccagtaggactaggagatgatgaccagtgcattgaagacgattttgccgcctggcgggaacttttgtggcctgaattagatcagttgcttagggatggtgacgacactaacaccgtgagtaccccctatactgccgtcatccctgagtacagagtcgtcatatacgatccgacaactacctcattcgaagacaagcatctatcaatggcaaatgggaatgcctcttacgacatccaccacccatgtcgcgttaatgtagctgttcaaagagaactgcataagccagagtctgatcgatcatgtatccatttggaattcgatatatcctctacagggatcacatatgagaccggtgatcatgtaggcgtgtacgccgacaactgtgatgaaactgtagaagaagctgcccgattgttgggccagcctttggatctacttttttccattcattccgacgacgataacggtactcccctaggtggtagtctgccgccaccttttccaggcccttgtaccttaaggacagctttggctagatatgccgacttattgaatccaccacgaaaagctgcccttattgcccttgcagcccatgccattgaaccatcagaatcggaaaaattaaaattcttgagttcgccacaaggaaaagacgattactctcaatgggtcgttgggtctcaacgtagtctattggaagttatggctgaatttcccagcgcaaagccaccattgggtgttttcttcgccgcagttgctactagattacagccaagatattattcaattagcagttctcctagatttgcaccttctagagttcatgttacttgctctttagtttacggtcccacatcaaccggacgtattcacaaaggagtttgttcaacctggatgaagaatgctgtaccattagaaaagtcacgcaactgttcatgggccccaatttttattcgtgcttcaaacttcaaattacctagcaacccaagtattcctatagtgatggttggtccaggcactggcttagcacctttcagaggcttcttacaagagagattggccctgaaggaagacggtattcaattgggtccagccttgcttttttttggttgcagaaatagaaggatggattttatatatgaggacgagttaaataacttcgtggaccgcggtgttcttagtgacttaattgtcgcctttagtagagagggtccgcagaaagaatatgttcaacacaagatgatggaaaaagcggcttacatttggaatctaatttctcaggaaggctatctatatgtatgcggcgatgccaagggaatggctcgagatgttcatagaactcttcataccattgtccaagaacaagaaaatgctgatacttcaaaggccgaatcggttgtgaaaaaacttcaaatggacgggcgctatttgagagatgtgtgg

SEQ ID NO: 1460 - DNA, 3477 bp, Artificial Sequence
  source: /note="Description of Artificial Sequence: Synthetic polynucleotide"
atggatttctttacaatcgcattgtcgttgttattcgcttttacgttatttaaagcaattatctcgctgacaaaatcgggtaaaaataaaaatcttcctcctggcccagcacccttacccatcatcggttctctgcataaattaggcgatcaaccccaccaaagcttggctaaattggctaagatatacggacctattatgagtctaaagttaggccggattaccactgtcgtgatttctagcagtgatgcagctaaagaagttctacaaaaaaaagatttagctttctcgtcgagacatgtcccagacgcattacatgctcacaatcaattcaaattttcagttgtctggttaccagtagcacctcaatggagatccttaaggaaaatcttgaactctaatatttttagcggtaaccggctagacgcaaatcaacaccttcgatgccggaaagtcgaagaactaatcacatactgcagaaaatcttcccattcaggagacgccgttgatataggtagagctgcttttcgtacaagtctaaatctattgtcaaatactattttcagtaaggatttaactgacccataccaagattctgccaaggagtttaaagaactagtaggtaacatcatggtagaagctggtaaacctaatttagttgatttttttccctctctaaaaaaaattgatcctcaagggatccgacatagaatgactattcattttggaaaggtcctggaactctttggaggactaattaatgaaagactagaattaaaatcatctcaaaaaagtgatgaaaaaaatgatgttctagacgtttgcttaagcattagcaaagagaaccctgatgagatcgacagaacacacatagaaaggatgtgtctcgacctgttcgttgccggtacggatactacatcatctacgttggaatgggctatggctgaagtcctaagaaatccagaaaccttggttaaagctaaagcggaattggaagaagttatcggcaagggtaagatcttggccgaagcagatgtatcgaacttgccatatctgaggtgtattgttaaggaaactcttagaatccatccgccagtaccattcctaattcctagaaaggtggaaatggatgtagaagcgtgtggttacactgtgcctaaaaatagtcaggtttttgttaatgtttgggcgataggaagagatcctactttatgggaagatcccctgagttttaaacctgaaagatttatggcatcggaattggacgtaaggggtcgtgacttcgagcttcttcctttcggagctggcaggagaatttgcccaggtctgccattggctatccgtatggttcccgtcatgctgggttctttagttaatagctttaactggaagttggatggtggtattgcccctaaggagttagatatgggtgagaaatttggtatcactttggcaaaagcacaaagtctcagagcagtcccatcaccactggtgggtggcggctctggcggaagcacatctagcggtagttccggtggttggcgaaagggtgccggttctgcaaagaaagttgtcgaacctccaaaactagttttaccaaaagctctctcagaaaccgaggaggtggacgacggaaaaaagaaggtcactattttttttggtacccaaactggtactgcagaaggttttgcgaaagctcttgcagaagaagccaaagcgagatatccacaagctaatttcaaagtcgtggatatggatgactatgcagcggaggacgaagagtacgaagagaaattgaccaaagagactatggctttttttttccttgcaacctacggtgatggtgagccaactgacaatgctgcacgcttttacaagtggttcgccgaaggtaaggaacgaggtgattcatttaaaaatttacattatggtgtgtttggtttgggaaatagacaatatgagcatttcaacaaaattgctatcgtagttgacaacattttggccgagcaaggcgggaaaagattggttcctgtaggtttaggggatgatgaccagtgtatcgaagacgatttcgcagcatggagagaaaatgtttggccggagcttgacaatttgttacgaaatgaggacgatgcaagtacagtatcgactccctatactgcagcggtgttggagtacagggtggagttccacgaccaaagtgacgagttatctttggagaactctctcgccaacggtcatgctaacggtaatgcctcatatgacgctcagcacccttgtagagcaaatgttgccgttaaaagagaattgcatacaccattatccgatagatcatgtacccaccttgaatttgacatatcaggcacaggcttacaatatgaaaccggtgatcatgtaggcgtttattgtgagaatctaattgagactgtcgaagaagctgaaagactgttgggtttgagcccacagacttattttagtgttcacaccgacaaagaagatggaactccccttggtggtagcgcacttcctccacctttcccaccctgtactttaaggacggccttatctcgatatgcggatttgttgaatgcccctaaaaagagtgcactgacagctcttgctgcttacgcgagtgaccctacggaagctgacagattaaaacacctagcttcacctgccggaaaggaagaatatgcccaatatgttgtggcttcccaaaggaccctactagaagtaatggccgatttcccatcggcaaagccacctctaggtgtgtttttcgcgggtgtcgccccaagattgcagcctagattttattccatttcttcttccccaaagattgctcccttcaggattcatgtaacctgcgctttggtgtatgacaaaactccaactggaagaatccataaaggtatctgttctacgtggataaagaatgctgtacctttggaggagagctcggattgttcgtcagctcctatctttgttcggaatagcaattttaaattaccatctgacgcaaacataccaattatcatgatcggtccaggcactgggctagcaccattcaggggttttttacaagaacgcctggctttaaaagagtccggtgcagaactgggcccagccattttgttctttggatgtcgtaacaggaaaatggacttcatatatgaagatgaactgaacgattttgtaaaggctggtgttgtgagtgagttgattgttgcctttagcagagaaggatcaactaaagaatacgttcaacacaagatggcacaacgtgcatctgacgtatggaaaatgatcagcgatggaggttacatttacgtctgcggcgacgcaaagggtatggctagagatgtacataggactttgcacaccatcgcccaagaacaaggctcaatgtcctcatccgaagccgagggtatggtaaaaaatttacaaatgacaggaaggtatctccgtgacgtctgg

SEQ ID NO: 1461 - DNA, 3477 bp, Artificial Sequence
  source: /note="Description of Artificial Sequence: Synthetic polynucleotide"
atggatttctttacaatcgcattgtcgttgttattcgcttttacgttatttaaagcaattatctcgctgacaaaatcgggtaaaaataaaaatcttcctcctggcccagcacccttacccatcatcggttctctgcataaattaggcgatcaaccccaccaaagcttggctaaattggctaagatatacggacctattatgagtctaaagttaggccggattaccactgtcgtgatttctagcagtgatgcagctaaagaagttctacaaaaaaaagatttagctttctcgtcgagacatgtcccagacgcattacatgctcacaatcaattcaaattttcagttgtctggttaccagtagcacctcaatggagatccttaaggaaaatcttgaactctaatatttttagcggtaaccggctagacgcaaatcaacaccttcgatgccggaaagtcgaagaactaatcacatactgcagaaaatcttcccattcaggagacgccgttgatataggtagagctgcttttcgtacaagtctaaatctattgtcaaatactattttcagtaaggatttaactgacccataccaagattctgccaaggagtttaaagaactagtaggtaacatcatggtagaagctggtaaacctaatttagttgatttttttccctctctaaaaaaaattgatcctcaagggatccgacatagaatgactattcattttggaaaggtcctggaactctttggaggactaattaatgaaagactagaattaaaatcatctcaaaaaagtgatgaaaaaaatgatgttctagacgtttgcttaagcattagcaaagagaaccctgatgagatcgacagaacacacatagaaaggatgtgtctcgacctgttcgttgccggtacggatactacatcatctacgttggaatgggctatggctgaagtcctaagaaatccagaaaccttggttaaagctaaagcggaattggaagaagttatcggcaagggtaagatcttggccgaagcagatgtatcgaacttgccatatctgaggtgtattgttaaggaaactcttagaatccatccgccagtaccattcctaattcctagaaaggtggaaatggatgtagaagcgtgtggttacactgtgcctaaaaatagtcaggtttttgttaatgtttgggcgataggaagagatcctactttatgggaagatcccctgagttttaaacctgaaagatttatggcatcggaattggacgtaaggggtcgtgacttcgagcttcttcctttcggagctggcaggagaatttgcccaggtctgccattggctatccgtatggttcccgtcatgctgggttctttagttaatagctttaactggaagttggatggtggtattgcccctaaggagttagatatgggtgagaaatttggtatcactttggcaaaagcacaaagtctcagagcagtcccatcaccactggtgggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttgg

SEQ ID NO: 1462 - DNA, 3459 bp, Artificial Sequence
  source: /note="Description of Artificial Sequence: Synthetic polynucleotide"
atggattttcttacaattttcataggtcctctgttggcaataatagctttgttttacgcgagattaactatctcgactcgcggtaaaaatttaccaccaggccccactccattgccttttatcggtaacttgcatttgcttggccatcatccacataaatcactagctagattagccaagacttacggcccattaatgctactgagactgggtagtgaaaacactgttgttgtatcaagtgctgctgtggcaaaggaggtattacagaaacacgacctagcctttagctcacgaagtatacctgacgcagttcacgcacatgatcaattcaagtacagcgtggtttggcttcctgtagcctccagatggcgttcccttcgtaagacaatgaactctaacattttttcaggttcgtgccttgatgccaatcaacatctacgttctaggaaggtcgaagaacttattgcgtattgtaaggaatcttgtcgtcgtgcagaagcagtagatgttggtagagcagcatttcgcacagctttaaatagtcttagtaatactattttttccagagatttggcagatccactatctgactcaggaaaggagtttaaagatgttgtcagtagtatcatgatggaagccggtaagccaaatagcgttgactactacccatttttatccagatttgaccctcagggcattagacgcagaacagcgatttatttcgataagttgatcaatattttcaaaggcttgattgatgaaagattagaaaagcgacggagccaatacgaagaagctacggatgttattgatattctcttaaatactattgagcaaaaccccgaagagattgatcgcacacatatagagagaatgtttttggatttgtttttagcaggcaccgataccacttcgtctaccgttgagtgggcaatggctgaagcaatgaagaatccggaaactatgaaaaaagccaaggcagagttagcacaagtcattggtaagggaaaaattgtgcaagaaacagatatacctcacctcccatatcttcaatgtatagtaaaggaaacacttagacttcatcctcctgtccctttcttaattccacgtcgcgtccacgaagatgtagatattttgggctacgtcgttccaaataactctcaggtcttcgtcaacatgtgggctatcggtcgggaccctgatatgtggaaaaatccactacagttcgatcccgatagatttcatgattctgaagttggcctaagaggtaaagattttgaacttatcccgttcggtgcgggtcgtagaatatgccctggactgccattggcaatgagaatggttccagtggtgttgggttctttactcaattcttttgattggaaggttgaaggtggtaaagaattagaaatgaatgagaaattcggaatcacattagaaaaagcacagccactgatggccgtcccgatagcattaggaggaggtagcggtggtagcactagtagtggtagtagcggtggatggagaagatcgtctggctcaggtaagaaagtagttgaaccaccaaaattgatcgttcccaagtcggttgtggaacctgaagaaattgatgaaggtaaaaagaaatttactatctttttcgggactcagactggcacagccgaaggtttcgccaaggccctcgcagaggaggctaaagcaagatatgaaaaagctgtcataaaagttattgatattgatgattatgctgctgacgatgaagaatacgaagagaaatttaggaaagaaactttagccttttttatacttgcaacgtacggggatggtgaaccaacagataacgcagctaggttctataaatggtttgtggaaggtaacgatagaggggattggttgaaaaatttacaatatggtgtattcggtttgggtaatcgacagtatgaacacttcaacaagattgccaaagtcgtcgatgagaaagtagcagagcaaggtgggaagagaattgtacctttagttttgggcgatgatgaccaatgtatagaagatgatttcgctgcctggagagaaaacgtttggccagaactagacaatttgctacgtgatgaggatgacaccaccgtttcaacgacttatactgctgctataccagagtatagggtggtttttccagataagtcggactctctgatctctgaagccaatggtcatgccaatggctatgcaaacggaaacactgtatatgacgctcaacacccctgtagatccaacgttgctgtgcgaaaggagcttcatactccggcctcggatcgttcttgcacacacctagacttcgatatcgcaggcaccggtctgagctatggaactggcgaccatgtcggagtttactgcgataatttgtccgaaacagttgaagaagctgagcgattgcttaacctgcctcctgagacttatttctccttacatgcagataaagaggatggtacgccacttgctggttcctccttaccgcccccttttccaccatgtacactacgaaccgcacttactcgttacgcagacttgttaaacacacctaagaaatcggcgttgctggctcttgcagcatacgcttcagatcctaatgaagccgatcgtttaaagtatctagcatctcctgcagggaaggacgaatatgcccaaagtttggtggctaatcaacgttctttattggaagttatggcagagttcccgagtgctaagccccccttaggtgttttcttcgcagctattgcccctagattgcaacctcgtttttattctatttcgtctagcccacgtatggccccatctagaattcatgtcacctgtgccttggtctacgagaagacaccaggtggtagaattcacaagggtgtgtgttcgacatggatgaagaacgccataccgctagaagaatctagggactgttcctgggcccctattttcgtaagacaaagcaattttaaattaccggctgatccgaaggtgccagttatcatgattggaccaggtacaggcctggcgccgtttcgaggttttctgcaggagaggttagctttgaaagaagaaggtgctgaattaggaaccgcagtttttttctttgggtgtagaaaccggaagatggattacatctatgaagatgaacttaaccatttcctagagattggggctctttcggaattgctggttgcttttagcagagaaggaccaactaagcaatatgtccaacacaagatggccgaaaaagcttccgatatctggagaatgatatctgacggagcttacgtgtatgtttgtggagacgcaaagggtatggctagggacgttcaccgcacattgcatactatagctcaagaacaaggttccatggattcaactcaagccgaaggctttgttaaaaatttgcaaatgactggtagatatttacgtgatgtatgg

SEQ ID NO: 1463 - DNA, 3879 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggcagtacttcctctggtatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaatttgtgattaaaattctgcaatttttggttccattattgattttgggtcttgcatttgcggtacgtcattacaccaaagaaaaa

SEQ ID NO: 1464 - DNA, 3810 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggcagtacttcctctggtatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaatacaccaaagaaaaa

SEQ ID NO: 1465 - DNA, 3795 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggcagtacttcctctggtatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaa

SEQ ID NO: 1466 - DNA, 3891 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggcagtacttcctctggtatgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaatattggttcgcatcaattactgtggcaggtttgtccgtggtcgttgggtatctttgcatccgaaaaaagcaaacaact

SEQ ID NO: 1467 - DNA, 3831 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggcagtacttcctctggtatgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaacgaaaaaagcaaacaact

SEQ ID NO: 1468 - DNA, 3813 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggcagtacttcctctggtatgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaa

SEQ ID NO: 1469 - DNA, 3759 bp, Artificial Sequence
  source: /note="Description of Artificial Sequence: Synthetic polynucleotide"
atggctttgttactggcggtatttcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggcagtacttcctctggtatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaa

SEQ ID NO: 1470 - DNA, 3906 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggtggcggctctggcggaagcacatctagcggtagttccggtggtatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaatttgtgattaaaattctgcaatttttggttccattattgattttgggtcttgcatttgcggtacgtcattacaccaaagaaaaa

SEQ ID NO: 1471 - DNA, 3837 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggtggcggctctggcggaagcacatctagcggtagttccggtggtatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaatacaccaaagaaaaa

SEQ ID NO: 1472 - DNA, 3822 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggtggcggctctggcggaagcacatctagcggtagttccggtggtatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaa

SEQ ID NO: 1473 - DNA, 3918 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggtggcggctctggcggaagcacatctagcggtagttccggtggtatgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaatattggttcgcatcaattactgtggcaggtttgtccgtggtcgttgggtatctttgcatccgaaaaaagcaaacaact

SEQ ID NO: 1474 - DNA, 3858 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggtggcggctctggcggaagcacatctagcggtagttccggtggtatgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaacgaaaaaagcaaacaact

SEQ ID NO: 1475 - DNA, 3840 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggggtggcggctctggcggaagcacatctagcggtagttccggtggtatgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaa

SEQ ID NO: 1476 - DNA, 3861 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaatttgtgattaaaattctgcaatttttggttccattattgattttgggtcttgcatttgcggtacgtcattacaccaaagaaaaa

SEQ ID NO: 1477 - DNA, 3792 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaatacaccaaagaaaaa

SEQ ID NO: 1478 - DNA, 3777 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggatggcgtccgatcaaaaattacataaatttgatgaagtatccaagcacaataagactaaagattgttggttaattattaatggtaaagtatacgatgtcactccatttatggatgatcatcctggcggtgacgaggttttgctgtctgcaactggcaaggatgcaactaacgactttgaagatgttggtcattcagactctgctagagaaatgatggacaagtattacattggggaaatggatatggcaaccgttccactaaaaagaacttacattccccctcaacaggcgcaatataatccagacaaaacaccagaa

SEQ ID NO: 1479 - DNA, 3873 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggatgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaatattggttcgcatcaattactgtggcaggtttgtccgtggtcgttgggtatctttgcatccgaaaaaagcaaacaact

SEQ ID NO: 1480 - DNA, 3813 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggatgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaacgaaaaaagcaaacaact

SEQ ID NO: 1481 - DNA, 3795 bp, Artificial Sequence
  source: /note="Description of Artificial Sequence: Synthetic polynucleotide"
atggattttctgacaattttcattggtcctcttctggcaatcattgcattgttctacgctcgcttaacaattagcactcgtggaaagaatctacccccaggtcccactcctttaccatttattggtaatttacacttgctcggtcatcatccccataagtctttggcacgtcttgccaagacttatggtccattgatgttacttagactagggtctgaaaatactgtggtcgtatcttcggctgccgttgctaaagaagtattgcaaaaacatgatttggcctttagttctcgatccatacctgatgcagttcatgcacacgatcaattcaagtactccgtggtttggttgccagttgcctctagatggagatctttaagaaaaactatgaactccaatatcttttcgggctcctgcttagatgccaatcagcatttaagaagtaggaaggttgaagaattaatcgcctattgtaaagaaagctgtaggcgtgctgaagcagtagacgtcgggcgtgctgctttcagaaccgctttaaattctttgtcaaacacaattttttctcgagaccttgctgatccattatccgactctggtaaggaatttaaggacgttgtttcttcgatcatgatggaggcgggcaagccaaacagtgtagactactatccgttcctgtctcgattcgatccccaaggaatccgtagaaggaccgcaatctattttgataaactgattaacatcttcaagggtttgattgacgaacgtctcgaaaaaagaaggtcgcagtacgaagaggctacggatgtaatcgatatattacttaacactattgaacagaacccagaagaaatcgaccgaactcatatcgagagaatgttcttagatctctttttggctggtacagatacgacatcttcgacggtcgaatgggccatggctgaagccatgaagaacccagaaaccatgaagaaagctaaggcggaattagctcaagttatcggcaaggggaaaatagtccaagaaactgatataccacacctaccatatttgcaatgcatcgtaaaggagacactacgattacacccacctgtacccttccttatcccacgtcgtgttcatgaagacgtggacatattgggttatgtcgttccaaataactcacaagtgttcgttaacatgtgggccattgggagggacccagatatgtggaaaaatccattacaatttgatcccgaccgttttcatgattccgaagtcggtctgagaggtaaagattttgaattgattcccttcggcgctggcagaagaatttgcccaggattacctttggctatgcgtatggtgcctgttgttttaggatctctcttgaactccttcgattggaaggtcgaaggtggtaaagaactggaaatgaatgaaaagtttggaataactcttgaaaaagcacaacctttaatggcagtacccatcgcattaggtggcggctctggcggaagcacatctagcggtagttccggtggttggagacggtcctccggatctggtaaaaaggttgttgaaccacctaaactaatcgtgccaaaaagtgttgtcgaaccagaggaaatcgatgaaggtaagaaaaagtttactatattttttggcacccagacaggtacggctgagggcttcgcaaaggcactagccgaggaagctaaagctaggtatgaaaaggcagtcattaaggttatcgatatagacgattatgcggctgatgacgaggaatatgaagaaaaatttaggaaggaaacgttagcttttttcattctggctacttacggcgatggtgaaccaacagacaatgcagccagattctacaagtggtttgttgaagggaatgacaggggtgattggttaaaaaatttgcaatacggtgtttttggcctcgggaatcgccagtacgaacatttcaataagatagccaaagtggtagatgagaaggttgcggaacaaggtggcaaacgtatcgtccccttagttttaggcgatgacgatcagtgtattgaagacgatttcgcggcatggcgtgaaaatgtttggcccgaacttgataatcttcttagagacgaagacgatactactgtttcaacaacctacacggccgcaatccccgaatacagagttgttttcccagataagtcagatagcttaatttcagaagcaaatggtcacgctaatggttatgctaatgggaatacggtctacgatgctcaacacccatgcagatctaatgttgcagtccgcaaggagttacacactccagcatcagatcgctcatgtactcatcttgatttcgatatcgctggcaccggattgagctacgggactggagatcatgtaggtgtctattgtgataatttatctgaaaccgtcgaggaagctgagaggttgcttaatctgccgcctgaaacgtattttagcctccacgctgataaggaagacggcacacctttggcaggatcttctttgcctcctccctttccaccttgtacattacggactgctttgactaggtatgcggatttgctgaacacccccaaaaagagcgctttgctggccttagctgcatatgcttccgatcctaatgaagccgatagactaaaatacctagccagtcccgctggcaaggacgagtacgcacaatctcttgtcgctaaccaaagatcgcttttagaggtaatggccgagtttccctctgcaaaaccaccacttggggtttttttcgcggctattgctcctcgtcttcaaccaaggttctattcaatttcctctagtccgcgtatggctcctagtagaatccatgttacatgtgcattagtctacgaaaagactccaggtggtagaattcataagggagtttgttctacttggatgaaaaatgctattccgctggaagaatcacgtgactgctcgtgggcccccatctttgtacgtcaaagtaattttaagcttcctgcagaccctaaggtgccagtgataatgataggtccaggtaccggcttggctcctttcagaggattcttacaggaaaggttagctttgaaggaagaaggcgcagaattgggtactgctgtgttcttctttggttgtcgtaacagaaaaatggactacatttacgaagatgagctaaaccatttcttagaaattggtgccttgtccgaactattagtcgccttcagcagggagggccctacgaagcaatacgttcagcataaaatggctgaaaaagcgtcagacatttggcgaatgataagtgatggtgcctatgtgtatgtgtgcggggatgcaaagggtatggctcgtgatgtccacagaacactacatactatcgcccaagagcaaggctcgatggattctacacaagctgaaggttttgtaaagaatctacaaatgacgggtaggtacctaagagatgtttggatgccgacattaactaagttatacacaatggaagaagcttctcaacataatacaaacgaagactgttggatagtcatagatggtaaagtctatgacgtcagctcttatgtcgatgatcatcctggcggtgatgacatactagttggagcaacaggtaaagatgctacagatgaattcgaagatgctggtcattctaaaagcgcaagagaattaatggagaaattttgtattggggaattagaagaaaccacaccaagtattccagaattggatatcgtctcacaaaagcaaaagatgaacgatcttccacataagatcttgaattttactaaacaa

SEQ ID NO: 1482 - DNA, 2313 bp, Artificial Sequence
  source: /note="Description of Artificial Sequence: Synthetic polynucleotide"
atgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaatttggcggtggatccggtatgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccg

SEQ ID NO: 1483 - DNA, 2337 bp, Artificial Sequence
  source: /note="Description of Artificial Sequence: Synthetic polynucleotide"
atgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaatttggcggtggatccggtatgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacg

SEQ ID NO: 1484 - DNA, 2328 bp, Artificial Sequence
  source: /note="Description of Artificial Sequence: Synthetic polynucleotide"
atgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaatttggtggtggcgggagcggtggaggaggatcaatgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccg

SEQ ID NO: 1485 - DNA, 2352 bp, Artificial Sequence
  source: /note="Description of Artificial Sequence: Synthetic polynucleotide"
atgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaatttggtggtggcgggagcggtggaggaggatcaatgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacg

SEQ ID NO: 1486 - DNA, 2343 bp, Artificial Sequence
  source: /note="Description of Artificial Sequence: Synthetic polynucleotide"
atgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaatttggaggtggaggttccggtggaggtggaagtggcggtggagggtcaatgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccg

SEQ ID NO: 1487 - DNA, 2367 bp, Artificial Sequence
  source: /note="Description of Artificial Sequence: Synthetic polynucleotide"
atgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaatttggaggtggaggttccggtggaggtggaagtggcggtggagggtcaatgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacg

SEQ ID NO: 1488 - DNA, 2313 bp, Artificial Sequence
  source: /note="Description of Artificial Sequence: Synthetic polynucleotide"
atgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccgggcggtggatccggtatgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaattt

SEQ ID NO: 1489 - DNA, 2328 bp, Artificial Sequence
  source: /note="Description of Artificial Sequence: Synthetic polynucleotide"
atgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccgggtggtggcgggagcggtggaggaggatcaatgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaattt

SEQ ID NO: 1490 - DNA, 2343 bp, Artificial Sequence
  source: /note="Description of Artificial Sequence: Synthetic polynucleotide"
atgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccgggaggtggaggttccggtggaggtggaagtggcggtggagggtcaatgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaattt

SEQ ID NO: 1491 - DNA, 2337 bp, Artificial Sequence
  source: /note="Description of Artificial Sequence: Synthetic polynucleotide"
atgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacgggcggtggatccggtatgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaattt

SEQ ID NO: 1492 - DNA, 2352 bp, Artificial Sequence
  source: /note="Description of Artificial Sequence: Synthetic polynucleotide"
atgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacgggtggtggcgggagcggtggaggaggatcaatgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaattt

SEQ ID NO: 1493 - DNA, 2367 bp, Artificial Sequence
  source: /note="Description of Artificial Sequence: Synthetic polynucleotide"
atgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacgggaggtggaggttccggtggaggtggaagtggcggtggagggtcaatgacaaagactaacagtccagccccatcggttattacatgtaaagccgccgttgtctggaaaagcggagaacctccaaaagtggaggaaattcaggtcgaccctcccaaagcaagtgaagtccgtataaaaatgctgtgcgcttccttatgtcacactgattttttagcgtgcaatgggttgcctgtgccgttattccccagaatacctgggcatgaaggagtcggaatgattgagagcgttggtgagaatgtgacgaacctaaaggagggagatattgtaatgcctctttatctaggtgaatgcggagagtgtttaaactgtaaatccggtagaacaaacctatgtcacaaatatcccttgggtttttcaggacttcttttggacggtacatcacgtatgtccatcggcgaacaaaaggtctaccatcattttagctgctctacctggtcagagtatattgttatagaggcggcttacgctgttaaagtcgatccaagggtgtcacttccacatgcttcgtttctttgttgcggatttactaccgggtttggcgctacttggcgcgatgttaatgtcgttaaggggagcacggtggccgtcttgggcctcggtgcagtcggacttggtgcagtacaaggcgcgaaaagtcaaggcgcttcgagaatcattgggttggatataaatgataaaaagagagagaaaggcgaagcgtttggtatgactgaattcatcaacccgaaaggttcaaataagtctatttctgaattgattaacgaagccactggtggtttaggacttgactacgtgtatgagtgcactggcgtccctgccttattaaatgaagctattgagtcttccaaagtaggtctaggtaccgctgttttgattggggctggactagaaacaagtggtgaaattaaattcattcccttattatgtggtaggacagtaaagggtagtatatacggtggggtgagacctaagagtgaccttccgacattgattgagaagtgtataaataaggagattcctatggatgaactgatgacccacgaggtttctctcagcgaaataaacaaaggctttgaatatctaaagcatccagattgtgtaaaggtggtgattaaattt

SEQ ID NO: 1494 - DNA, 1953 bp, Artificial Sequence
  source: /note="Description of Artificial Sequence: Synthetic polynucleotide"
atgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccgggcggtggatccggtatggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgca

SEQ ID NO: 1495 - DNA, 1968 bp, Artificial Sequence
  source: /note="Description of Artificial Sequence: Synthetic polynucleotide"
atgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccgggtggtggcgggagcggtggaggaggatcaatggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgca

SEQ ID NO: 1496 - DNA, 1983 bp, Artificial Sequence
  source: /note="Description of Artificial Sequence: Synthetic polynucleotide"
atgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccgggaggtggaggttccggtggaggtggaagtggcggtggagggtcaatggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgca

SEQ ID NO: 1497 - DNA, 1977 bp, Artificial Sequence
  source: /note="Description of Artificial Sequence: Synthetic polynucleotide"
atgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacgggcggtggatccggtatggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgca

SEQ ID NO: 1498 - DNA, 1992 bp, Artificial Sequence
  source: /note="Description of Artificial Sequence: Synthetic polynucleotide"
atgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacgggtggtggcgggagcggtggaggaggatcaatggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgca

SEQ ID NO: 1499 - DNA, 2007 bp, Artificial Sequence
  source: /note="Description of Artificial Sequence: Synthetic polynucleotide"
atgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacgggaggtggaggttccggtggaggtggaagtggcggtggagggtcaatggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgca

SEQ ID NO: 1500 - DNA, 1953 bp, Artificial Sequence
  source: /note="Description of Artificial Sequence: Synthetic polynucleotide"
atggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgcaggcggtggatccggtatgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccg

SEQ ID NO: 1501 - DNA, 1977 bp, Artificial Sequence
  source: /note="Description of Artificial Sequence: Synthetic polynucleotide"
atggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgcaggcggtggatccggtatgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacg

SEQ ID NO: 1502 - DNA, 1968 bp, Artificial Sequence
  source: /note="Description of Artificial Sequence: Synthetic polynucleotide"
atggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgcaggtggtggcgggagcggtggaggaggatcaatgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccg

SEQ ID NO: 1503 - DNA, 1992 bp, Artificial Sequence
  source: /note="Description of Artificial Sequence: Synthetic polynucleotide"
atggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgcaggtggtggcgggagcggtggaggaggatcaatgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacg

SEQ ID NO: 1504 - DNA, 1983 bp, Artificial Sequence
  source: /note="Description of Artificial Sequence: Synthetic polynucleotide"
atggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgcaggaggtggaggttccggtggaggtggaagtggcggtggagggtcaatgtcttggtggtggaaaagatcaataggtgccggcaaaaatctcccgaaccaaaacaaagagaacggggtatgcaagtcgtacaaatcggtcgctctagttgtgggcgttactggtattgttggcagttccctagccgaagtccttaaattgcccgatacccctggtggtccgtggaaagtatatggtgtcgctaggcgtccatgtcctgtatggcttgccaagaaacctgttgagtacattcaatgtgatgtgtccgataatcaagaaaccatatcaaaattgagccccttgaaggatatcacccacattttctacgtatcttggatcggatctgaagactgccaaactaatgccacaatgttcaaaaatattctgaatagtgtcatacccaatgcttctaatttacagcatgtttgtctacaaaccggtattaaacattattttggcatatttgaagaaggttctaaagtagtgccgcatgattctccatttaccgaggatcttcccagattgaatgttccaaatttttaccacgacttagaggacatattatatgaggagacaggaaagaataacctcacgtggtctgtgcatagacctgcattagtattcggattttctccctgcagtatgatgaacattgtgagtactctttgcgtgtatgcgacaatttgcaagcatgagaataaggctttagtttacccagggagcaagaatagctggaactgttatgctgatgctgtagatgcagatttggtagccgaacatgaaatctgggcagccgtcgatccaaaagccaaaaatcaagtattaaattgcaacaatggggatgttttcaaatggaaacatatatggaagaaactggccgaggaattcggtattgaaatggtagggtatgttgaaggtaaagaacaagtctccttggcagagctaatgaaagataaggatcaagtttgggacgagattgtaaaaaaaaataacttagttcctactaagttgaaagaaatagcagctttttggtttgctgatattgcattttgctctgaaaatctaattagttcaatgaataagtccaaagaattgggatttttaggttttaggaacagtatgaagtcttttgtttcctgcattgataagatgagggactacagatttattccg

SEQ ID NO: 1505 - DNA, 2007 bp, Artificial Sequence
  source: /note="Description of Artificial Sequence: Synthetic polynucleotide"
atggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgcaggaggtggaggttccggtggaggtggaagtggcggtggagggtcaatgtcgctttcgtggtggagagccggagccgctaaaaagagaatggatgatgatgaatcccttttggttaaacaacagcagcagcaatgtgtggctctaattgttggcgtcaccgggttagtgggtaattcactagcagaaatgttaccactaccagatactccaggcgggccatggaaagtgtatggcgtagcaagacgggctcgtccttcatggaatgaagatcaaccaatgacatatatatcatgcgatgtcagtaacaccggcgaagtggaagccaaattatctcctttgtcagatgtaactcatattttttacgctacgtggacgtctagatccacagaggaggaaaattgtgaagcaaatggcaaaatgctcaaaaatgttctagatgcaatgataccgaattgccctaacttgaaacacatttgtctacaaaccggtagatttcattatgttgcttccgttgtagactggaagatcaatggatcacacgacaccccactaaccgaagacttgcccagattaaaaactaacaatttttattatacccaagaggacattcttttagaggaagttaagagaaaagaaggtcttacttggtcggttcatcgtccaggtacaatcttcggattctctccttattccatgatgaatctcgttggtacattatgcgtctatgctgccatatgtaaacaagaaggtgcagttttgcgatttcccggttgcaaaggtgcgtgggatggacattctgactgtgctgatgccgatttgatcgctgaacaacaaatatgggccgcattagacccgcatgctaagaaccaagctttcaatgtatcgaacggagatttattcaagtggaaacatttatggaaagttctcgccgaccaatttggtgtggagtgtggtgactatgaggaaggacaacagttgagattgcaagacgttatgaaagacaagggtcctgtttgggacaagatcgtggcagaaaacggactttctaacacaaagctcgaagacgtcggtaagtggtggttttccgacacaattttgtggaatgaatgtcgcttggattctatgaataaaagtaaagaacatgggttcttaggtttcagaaattcaaagaattgctttttgtactggatacataaagtcaaagcctacaatctcgtgccaagtacatatacg

SEQ ID NO: 1506 - DNA, 810 bp, Nepeta mussinii
atggctaataactcagtcatgatgaagaagaagttggaaggcaaggttgctatcgttaccggtggtgcttctgggattggtgaagcgacagcaaggttatttgtcaaatacggtgctagagcggttgtgattgcagatattcagtctgagttgggtcgttcggtcgctgaaagtataggtaaggaaaggtgcagttttgttcagtgcgacgttgccgacgaagaacaagtaaaatcaatgatagagtggacggccacgacttacggaggactcgatgttatgttttctaatgccggggtgttaaattccgctgctcaaacagttaaagatttagatttaccattattcgataaagttatgagggttaacactagaggggccgcagtctgtgtaaagcaagctgcacgtaaaatggttgaactcggtcgcggaggatctattatttgtaacgccggttcgtctgctgttcgtggagctcatggtgtgactgactacgttatgagcaagcatgctgttatcggtttagttagatcagccagtatgcagctgggggcgcattccattcgtgtcaattccgtcagtcccatggcggtcgctacaccattaacgcgtaatcaaggtatttcgacaccagacgatgtacagaaattcttgatgcctttcatttcattaaagggagtcccacctacagccgagcaggtcgctgaagccgctgcctttttaggttccgacgaagctgcttttgtcacaggtcatgaccttccagtggatggtggagtactatgtatgccattccttttaggttctgca

SEQ ID NO: 1507 - DNA, 810 bp, Nepeta mussinii
atggcaaacaactccgtaatgatgaagaaaaaattagaaggcaaggttgcaattgtaactggaggtgcgtccgggatcggtgaagccaccgcgcgtttattcgttaaatatggtgctcgagccgtcgtcatagctgatatacagtcagaattaggtaggagcgtagcagaaagcattggaaaagaaaggtgcagctttgttcaatgtgatgtagcagacgaagaacaggtcaaatcaatgattgaatggacggccactacatatggtggactagatgtaatgttttcaaacgccggtgttctcaacagtgccgcgcaaaccgtcaaggatttggaccttccgctttttgataaagttatgagggttaacacaaggggtgctgcagtctgtgtaaaacaagcagcacgtaagatggtcgaattaggtagaggggggagcattatatgtaatgctggttcaagcgcggtccgtggtgctcatggcgtgacagactacgtcatgtcaaagcatgctgttatcggtctggtcagatctgcctcgatgcaactaggtgcacactcaatccgtgtaaattcggtatctccaatggcagtcgcaaccccgctaaccagaaatcaaggtatctcaacccccgatgatgttcaaaagttcctcatgccgtttatatcgttaaagggtgttccaccaacggctgaacaggtcgctgaagctgctgcatttttgggttcggacgaagcggcctttgtaacgggtcacgacctacctgtcgacggtggtgtcttatgtatgccgttcttactgggatctgca

SEQ ID NO: 1508 - DNA, 774 bp, Catharanthus roseus
atggaggtcatgaaacatttcgttaccgtacatggagtcggccatggtgcctgggtctactataagcttaaaccgcgcatcgaagccgcaggccatagatgtacagcagttaatctggccgcatccggtattaacgaaaagaaactagaagaagttagaagttcgatcgattatgcagcccctttattagaggttctcgactccgtgccagagaacgagaaagttatattggtaggtcatagcggtggcggaatgactgccgctgtaggtatggagaaattcccaaacaaaattagcttggctgtatttctgaacgctatcatgcctgacacagaaaatcgcccatcttatgttttggaagaatatactgcaaagacgccccccgaagcttggaaagactgtcaattctccgcttacggtgacccacccataacatctttagtttgtggccccgagttcatctcatcaaccctataccacttaagtcctattgaggatcacgctctcggaaaaatcttggtaagacctggaagtttgtttattgaggatctgttgaaagctgagaaatttacagaagagggtttcggatcggtcccaagagtttatgtgatagcagccgaggacaaaaccataccacctgagtttcaaagatggatgatagaaaataatcctgttaaagaggtgaaggaaattaagggagctgaccatatgccaatgttttctaaaccggatgaattgagtcaatgtttgttggatatcgcaaagaagcacgca

SEQ ID NO: 1509 - DNA, 792 bp, Camptotheca acuminata
atggaagttttgtctaaaccgaaaaagcatttcgtgttgacacatggtgcatgtcacggggcatgggtttggtataaagttaaacccagaattgaggctgccggtcataggtttactgccgtaaatttggctgcttgcggcgtaaataaaaagcagttggacgaagtacgctcgttatacgactataccttaccactattagaggttttggctagtatcccagaaaacgaaaaggttatcttagttggtcatagcggcggtggtatgtctgcagctttgggtatggaaaaatatcctgaaaagattagcgttgcggttttcttgaatgctataatgcccgatactactcacggtccctcttatgttttagatcaatataccggaggaaccccaccagaggcatggaaggacacagaatttattacttttggtgatcctaaggaacccttatccggattggtcgtggggcctaaattcctaaagaccaccctctatcctttgtgtagcgacgaagactacacattgggtacattattggttcggccagggtcgttgttcatggaagatttacataaggcagacaagttcacagatgaaggattcggctcggtaaaacgtgtgtacgttgtctgtgatgaagataaaacaataccagctgagttccaaaggtggatgattgaaaataatccagtgaaagaagtaaaggaaataaagggtgctgatcatatgccgatgttcagtaaacaagatgaagtctgcaagtgcttattggaaattgcagaaaaatataat

SEQ ID NO: 1510 - DNA, 777 bp, Vinca minor
atggcagctctagcaaaacactttgtagcagtacatggggtcggtcatggttcatgggtatactacaaattaaaaccaagaatagaagcggcaggtcaccgcttcacagccgtaaacttagctgccgctggtataaatgagaaaaagttagaggaggtaagaagtagtgttgaatacgcagctccactactagaagtattgggttccgttcctgagaacgaaaaagtgattttaattgggcattctggagggggtatgacagccgcagttggtatggagaaatttgccaacaaaatctctttggcggtgtttcttaacgctatcatgcccgatactaaaaatcgtccaagttacgttttggaagaatatacggctaagacccctccagaagcttggaaagattgccaatttagcgcttatggtgagcctccaattacttccctggtttgtggtcctgagtttattgcttctacattataccacttgtctacagtagaggatcacgcacttggaagcttgttagtcagacccggatcactttttatggaggatttgttacaagctgaaaaatttaccgaggaaggtttcggttcagttccgcgtgtttacgtaattgccgctgaggataagactattccacctgaatttcaaagatggatgattgaaaataatcctgttaaggaagtgaaagaaataaaaggttcagatcatatgcccatgttctcaaaaccagacgatctctgcaaatgtctcttggagatagcaaagcaacatgct

SEQ ID NO: 1511 - DNA, 783 bp, Rauvolfia serpentina
atggaagttgcaaaactgcaaaaacactttgtagctgtccatggtgttggtcacggtgcctgggtttactataaattgaagccaaggattgaagcggtcggtcacaggtttacagctgtgcacctggctgccgctggtatcaatgagaagaagctacaagaagttagatctagcgttgaatatgctgcgccattgctcgaagtacttgcatcagtcccagaaaatgagaaggtaattctcattggtcattcagggggcgggatgacagctgctgtaggtatggaaaagttcccgaataaaatctctatggccgtatttttaaatgcaatcatgcctgacacgaagaacagaccaagttatgtgctggaggaatatactgcgaggactcccgttgaggcctggaaagattgtcaattctctgcttatggtgacccgcctatcacctcgttggtctgtggtcccgaatttatctcatccacgctgtaccacttgtctcctgtcgaagaccatgccctaggtaagctcttagtgcggccaggctcgttatttattgaagacttgttaaaagcggataaattcactgaaaagggtttcggttctgttccgcgtgtctacgtggtagcagctgaagataagacaattccacctgaatttcaaagatggatgatcgagaactctccagttaaagaagtcaaagagatcaagggagccgatcatatgccaatgttttccaagcctgatgagttgtgccaatgtcttctcgaaattgcaaagcaacacgcg

SEQ ID NO: 1512 - DNA, 774 bp, Catharanthus roseus
atggaagtaatgaaacacttcgttaccgttcacggtgtgggccacggggcctgggtatactataagttaaagcccaggatcgaggcagctggtcacaggtgtaccgcagtgaacctggctgcgtccggaatcaacgaaaaaaaactagaggaagtaaggtcaagtatagactatgcagccccactgcttgaggttttggactccgtgcccgaaaacgagaaagttatcctagtcggccattcaggcggaggaatgaccgcagcagtaggtatggagaagtttccgaacaagatcagtctggccgtatttctgaacgccataatgcctgacactgaaaaccgtcctagttacgttctggaagagtatacggccaaaacacctcccgaggcttggaaggactgccagttctcagcctacggggatccaccaatcacttctttggtatgtggtcctgagttcatttcttcaaccctataccatttgagccccattgaggatcacgcgctgggaaaaattctagttaggcccggttctctttttattgaggacctactgaaggctgaaaagttcacagaggagggtttcggtagtgtgcctcgtgtctatgtgatagcggctgaagacaagaccattcctccggaatttcaaaggtggatgattgaaaataatcctgttaaggaagtcaaagaaatcaaaggggcggaccacatgccgatgttctccaaacccgacgaactgagccaatgcttacttgacatagcaaagaaacacgca

SEQ ID NO: 1513 - DNA, 792 bp, Camptotheca acuminata
atggaggtactaagcaagcccaagaagcattttgttcttacacacggagcatgccacggtgcttgggtatggtataaagtgaagcctagaatagaggcagcaggccaccgtttcactgccgtcaatctagctgcctgtggggtgaacaagaaacaactggatgaagtgagatctctatacgactacactctaccgctgctggaagtgcttgcaagtatcccggagaatgagaaagtgatcttggttggtcactcaggtggcgggatgagtgccgcgttaggtatggagaaatacccagagaagataagcgttgctgtctttctgaacgcaattatgccagacacgacgcacggtcctagctatgttctagatcagtacacaggcggtactccgcccgaagcttggaaggatactgagttcataacctttggcgacccgaaggagcctctgagcgggcttgtcgtaggcccgaagtttctaaaaaccaccctatatcccctgtgttccgatgaggactacaccttaggcacgctgctagttcgtccgggatcattatttatggaggaccttcacaaggcggataagttcacggacgaagggtttggctctgttaaaagagtctatgttgtttgcgatgaagataagacaatacctgctgaattccaaaggtggatgattgagaataaccctgtaaaagaggtaaaagaaataaaaggggctgaccacatgcctatgttttccaagcaagatgaggtctgcaagtgtttgttagaaatagcagaaaagtataac

SEQ ID NO: 1514 - DNA, 777 bp, Vinca minor
atggctgccttagcgaagcatttcgttgcggtgcatggagtcggtcacgggagttgggtgtactacaagctaaaaccccgtattgaagcagcaggacaccgttttactgcggtcaatttggcagccgccggaatcaacgagaaaaagctagaggaggtcagatcatccgtcgaatatgctgcgccgttacttgaagtccttggctcagtgcccgaaaatgaaaaggttatcttaataggccactccggcgggggcatgactgccgcagtaggcatggaaaaatttgcaaataagatttccctggcagttttccttaatgccatcatgcctgacactaagaataggccttcatatgttctggaagagtataccgcaaaaactccacctgaagcctggaaagattgccaattttctgcttatggggaacctccaattacaagcctggtatgcggtccagagtttattgcgtctacactataccatctatccactgtagaggatcacgccttgggttctttgttggttagacccggttccctgtttatggaagacttgctacaagcggaaaagtttacggaggaaggctttggctctgtaccaagagtctatgtaatagctgcggaggataagacaatcccgcccgagtttcaacgttggatgatcgaaaataaccccgttaaggaggtcaaggaaataaagggatccgaccacatgccaatgttctcaaagccagatgacttgtgtaagtgtttactggaaatagcaaagcaacatgct

SEQ ID NO: 1515 - DNA, 783 bp, Rauvolfia serpentina
atggaggtggccaaactgcaaaagcatttcgttgcagtgcatggcgtaggacatggcgcttgggtctattacaagttaaaaccccgtatagaggctgtgggacatagattcaccgctgtccaccttgcggcggctggaatcaacgagaagaaactgcaagaggttaggagttcagtggagtacgccgcgccgcttctggaagtccttgcaagcgtgccagaaaatgaaaaagtaatactaataggacattctggtggtgggatgactgcggccgtcggcatggagaaattcccaaataaaatttcaatggcagtgttcctgaatgcaatcatgccagacacaaaaaataggccgagctacgtgttggaagagtacaccgctcgtacaccagtcgaagcatggaaagattgtcagttttccgcttacggtgatccacctataacaagcctagtatgtggtcccgaattcatttctagtacactatatcacttgagtcctgtagaagaccatgcgctgggcaagctattggtgagaccgggtagccttttcatcgaagatttactgaaggccgataaattcacggagaaaggtttcggaagtgtaccaagggtgtacgtggtagccgctgaagacaaaacaatacctcccgaattccagcgttggatgatagaaaattccccggtaaaggaagttaaagagattaaaggcgctgatcatatgcctatgttcagtaagccggatgaactatgtcagtgtttactggagatcgccaaacagcatgct

SEQ ID NO: 1516 - DNA, 804 bp, Nepeta mussinii
atggggaataagaaaacattggagggaaaggttgccattgttactggtggtgcaagcgggattggtgaaactgccgcaagggtgtttgcaaatttaggagccagagctgttgttattgctgatattcaatctgaactgggcagagaagtagccgagagcatcggtgctaaaaggtgtagttacgtccagtgtgatatcggcgatgaggaacaagtgaaatctatggtggagtggaccgccaccacttatggtgcacttgacgttatgttctgcaatgccggaatcatgtcaaaagcagaatcggctcaaactgttttggaattggatatgagtaaattcgatgaggttatgagagtcaatacccggggcacatctgcttgtgtaaaacaagctgctagaaaaatggtagagcttgggactaaaggaggcgctattgtttgtactagtagtccattagcttctcgtggtggctatatagataccgattatgtaatgagtaaacatgccgttatgggattagtgagatccgcttctatgcaactaggagctcacgggattcgcgtcaactctgtctctcctatggcagtcttgactccactgacccgcagaatggggttggcaactcccgctgatgttgaaaatgcttttgggcggtttacctccttaaaaggcgtagctttaactgccgagcatgtggctgaggccgctgcttttttggcctcagatgaggcagctttcataactggtcatgatttgatggttgatggtggtttattgtgcttaccattctttgcccctacttca

SEQ ID NO: 1517 - DNA, 804 bp, Nepeta mussinii
atgggtaataaaaaaaccttagaaggcaaggtggcgattgttactggaggtgcctctggtattggtgagacagctgctagggtcttcgctaaccttggtgctagagccgtcgtgatcgctgacatccaaagcgagttgggccgtgaggtggccgagtctattggcgctaaaagatgctcctacgtacaatgtgacataggcgatgaggaacaagtcaagtcaatggtcgagtggaccgcaacaacttacggagccttggatgtgatgttttgtaacgcaggtatcatgagcaaagcagagtcagctcaaactgtcttggaattggatatgtccaaatttgatgaagtcatgagagttaacaccagaggtaccagtgcgtgcgtaaaacaagccgcaagaaagatggttgaattaggaaccaaaggtggagctattgtgtgcacatcctctcccctagcatcacgcggtggctatattgacaccgactatgttatgtctaaacatgccgttatgggcttagtaaggtccgcatcaatgcaacttggcgcacatggtattagagtaaatagtgtctcgccaatggcagtgttaactcctttgacccgacgtatgggtttagcaacaccagctgacgttgaaaacgccttcggacgttttacaagtctaaaaggtgtggctttaacggccgaacatgtggcagaagccgcagcatttttggcttccgatgaagcggcattcatcaccggacacgatcttatggtggatggcggtttactttgcttgcctttctttgcacctacatcc

SEQ ID NO: 1518 - DNA, 774 bp, Catharanthus roseus
atggaggtgatgaaacactttgttacggtgcatggcgtggggcatggagcgtgggtgtactataaactgaaaccccggatcgaggcggcgggtcaccgctgcaccgcggtaaacttagcagcaagtggaattaacgagaaaaaactggaggaagttcgtagctccattgactacgccgcaccgttgctcgaagtgctggattcggtaccagaaaacgagaaggtcattctggtaggccattcggggggcggcatgacagcggcagtagggatggaaaaatttccaaacaaaatttcgctggcggtattcctgaacgccattatgccggacacggaaaaccgcccgagttatgtattggaagaatatacagcaaagactccgcccgaagcgtggaaagattgccagttttccgcatatggggatccacccattacgtctctggtgtgcggtccggagtttatttcgtcaaccctgtatcatctgagtccgattgaagaccatgcgcttggtaagatcctcgttcgtccaggttcccttttcattgaggatctgttaaaggccgaaaagttcaccgaggaaggttttgggagcgtgccgcgtgtgtatgttattgcagccgaagataaaacgattccgccggaattccagcgctggatgattgaaaacaatccggtgaaagaggtgaaagaaattaagggtgccgatcacatgccgatgtttagtaaacctgatgagctgtctcagtgcctcctggatattgcgaaaaaacatgcc

SEQ ID NO: 1519 - DNA, 792 bp, Camptotheca acuminata
atggaagtcttaagcaaaccgaaaaaacacttcgtcctgacgcatggcgcttgccatggcgcctgggtgtggtacaaggtgaagccgcgtattgaagcggcgggccaccgctttaccgccgttaatctggcggcctgcggcgttaacaaaaagcagttagatgaggtgcgcagtctgtatgactataccctgcctttactggaggtcttagcctcgattccggaaaatgagaaggtgatcctggtcggtcacagcggtgggggtatgagcgccgcattaggaatggaaaagtaccctgaaaagattagtgtcgccgtgttcttaaacgccatcatgccggacaccacccatggtccgagttatgttttagatcagtataccggcggtaccccgcccgaggcatggaaagataccgaatttattacgttcggtgaccctaaggagcccctatcgggcctagtagtaggcccgaagtttttaaaaacgaccctttacccgctttgtagcgatgaagattatacgctgggtacgctgctggttcgtccaggcagtctgtttatggaggacctgcacaaagcggataagtttacggatgaaggattcggctcagtgaaacgtgtgtatgtggtgtgtgacgaagacaaaaccatccctgctgagtttcagcgttggatgattgaaaacaatccggtgaaggaagtgaaagaaataaaaggagcagatcatatgccgatgttttctaaacaggatgaagtgtgcaaatgcctgctcgagatcgcggagaaatataat

SEQ ID NO: 1520 - DNA, 777 bp, Vinca minor
atggcggcactggccaaacatttcgtggcggtccatggtgtggggcatggctcgtgggtatattataaactgaaaccgcggattgaagccgcaggacaccgttttaccgcagtaaacctcgcagccgcgggaataaacgagaaaaaattggaggaagtacgtagctctgtggagtatgccgctccgctgctggaggtcttgggcagcgttccggaaaatgaaaaagtcattttgatcggccattcgggtggaggcatgacggccgcggttggcatggagaaattcgcgaacaaaattagtcttgctgttttcctgaatgccattatgccggacacgaaaaaccgaccgagttacgttctcgaggaatataccgcaaaaacccctccagaagcgtggaaagactgtcagttttcggcctacggtgaaccgccgatcacctcgctagtttgcgggccggagtttatcgcctcgacgctttaccatttatcaactgtggaagatcacgccctgggctcgctgttggttcgcccgggctcactgttcatggaggatctactacaggcggaaaaattcactgaagaaggttttggctcggttccgcgtgtatatgttatcgccgctgaagacaaaaccattccgcccgaatttcagcgttggatgattgagaataacccggtcaaggaagtgaaggaaattaaaggctcggatcacatgccgatgttctctaaaccagatgatctctgtaaatgtcttctggaaatcgcaaagcagcatgcc

SEQ ID NO: 1521 - DNA, 783 bp, Rauvolfia serpentina
atggaagttgccaaattgcagaagcatttcgtagcggtgcacggcgtgggccacggcgcttgggtgtactacaagctgaaaccgcgcatcgaagccgtgggccaccggttcacggcggttcaccttgcggccgccggcattaacgaaaagaaacttcaggaagttcgctcttcggtagagtatgcggcgcctcttctagaggttctcgcgtctgttcctgagaatgaaaaagtaatactgattggccactccgggggtggaatgaccgcagcggtaggcatggaaaaatttccgaacaaaattagcatggccgtgttcctgaatgcaattatgccggatacaaagaatcgcccgtcttatgttctggaagaatataccgcccgcacacctgtcgaggcgtggaaagattgccagttctcagcctatggtgatccgcctattacaagcctagtgtgtggccccgagttcatttcttcgactttataccatctgagtcctgtcgaagaccatgcgctgggcaagcttcttgtgcgccctggctcactgttcatcgaggatctccttaaagcggataaattcaccgaaaaaggcttcggatcggtgccgcgcgtctatgtggtggccgcagaggataaaaccatacccccagaattccagcgttggatgatcgaaaactcaccggtcaaagaagtgaaagaaattaaaggcgcggatcacatgcctatgttttcgaagccagacgaattatgccagtgcctgttggagattgcaaaacagcacgcg

SEQ ID NO: 1522 - DNA, 783 bp, Andrographis paniculata
atggtcggtactgcagcacaacattttgtcgcagtacatggtgtagggcatggtgcttgggtttactataaagtcaagcctagaatggaagcagctggagtgcggtttacaccagtctctctggctgcagctggtaataatggaaagaaattggaggaagtacgcagtttgcatgattacacaactccattgttagaagtacttgccgctgtaccagccggcgaaaaggttgtattggtaggtcattcaggtggaggatatcctgctgcttacgcaatggaaaaatttccagagaaaatttctgtggcagtctttgtcaatgcattaatgcccgatacaaagaacagaccaagttacgtgattgatgagtatttggcaaggactccacctgaagcatggatggatacccaattccctacatatggtgatcctcccataacagctttggttgttggcccgaagtttatttcggattccttgtataacttaagcccagtcgaagatcaagccttaggtcacttatcagttaggcctggttcactctttatggaagatttagcgactatggataaatttagtgatgataaatttggtagtgttaggagggcctacattgttgcggctgatgataagactataccagcagaattccagcgctggctgatcgaaaacaatcctgttgctgaggttaaagaaattaagggtgccgaccatatgcctatgtttactcaaccggatgccctatgcaagtgcctattagagatcgctcaaaagcatgcagct

SEQ ID NO: 1523 - DNA, 777 bp, Gentiana triflora
atgtctccaacgaaacattttgttgcggttcacggtgtcggtcacggcgcatgggtttactataagcttaagccacgaattgaggcagctggttttaaattcaccgccatagacctagcagctgccggtgtaaacccaaaaaaattagaagaagtcaacagcttggaagaatactgtggaccactttttgatgttctcgccgctgtacctgagggagagaaggtcatcctcgtaggtcactctggtggtgggttatcggccgctgttgggatggaaaaatttcctaagaaaataagtgtggctgtattcttaaacgctatcatgccggatactaagaacagaccatcttatgttatggaagaatacacagcaagaactcccatcgaggcttggaaagacactcaattctccgcatacggtgaacctcctattacggcgttgttgtgtggtccggaattcataagcactagcttgtaccacctttctcctgtagaagatcatacactgggtaagttgttggttagacctggtgctctttttgttgaagatttattgaagggtgctgtgaaatttacagatgaaggtttcggctccgtcccaagagtctacgtggtcgccactgaagacaagacgattcctccagaattccaaagatggatgatagaaaacaatccagtggctgaagttaaagagatacagggcgcagatcatctgcctcaattctctaaacctgatgaacttacacaagtactagttgacatcgctaaaaatcatggc

SEQ ID NO: 1524 - DNA, 792 bp, Coffea canephora
atggaagccataaaggaacaacccaaacactttgttgcagtacacggggttggtcatggtgcatgggtttactacaaattgaaaccccgcattgaagcagccggtcatagatttacgcctgttgatttagctggggcggggaggaatgaaaaaaagttagaagagattagaactatggttgattacacccgtcctcttttggaggttttggcgtccatccctgaaaatgaaaaagtcattttgatcgggcacagtggaggaggcatggctgccgcggtgggtctggaaaagtatcctaacaaggtgtctgttggtgtcttcttgaacgctatcatgccagatgcgaagaatagacctagttacgtattcgaggagtacacggcacgcacgccaatagagaagtggttagatactaaattctttccgtatggtgatcctcctatcatggctttgctctgcggtccagagttcatttccaattccctatataatagatcccccaaggaagaccaggctctcgggaaattattagtaagaccgggatctcttttcatggaagatttattgcagactgagaagttatttaccgaagaacgttttggtagtgtccctcaggcgtatgtgatcgcatcggatgacaaaactataaccgcagatttccaacgctggatgattcagaacaacccttgcgttaaggaagtaaaggaaatcaagggtgctgatcacatgcccatgttcaccaagcccgatgaactgtgtcaatgtctgttagagatagccaagacttatgcc

SEQ ID NO: 1525 - DNA, 786 bp, Ophiorrhiza pumila
atggaggctactaagcaacaacaaaaacactttgttgcggttcacggcgttggccatggagcctgggtgtattacaagttaaagcctcgtattgaagcggctggacacctatttcgggcgattgatttaagcgcatctggcgcaaatgatacaaagcttgaagaaatccattcattacatgaatatacgaagccacttttggatgtactagctagtgttccagagaatgagaaagtgattttgatcggtcacagcggcggcggtatgggagcagcagttggaatggagaaataccctgataagatctctctggctatatttctgaatgctattatgccagattccaaaaatccaccgtcttacgtactggaacaatataccgcgcggacacctctggatgcttggaaagacacgaaattttctgcctatggcgacccacctataacatctttattggtgggtcctgaatttatttcctcgactctttaccatctatcaccaaaggaagaccaggccttgggtaaattattagttcgtccgggttctttgtttattgaagaccttctaaaagctgacaagttctctgatgaaggatttggtagtgttccacgtgcctacgttatcgctggtgatgataaaacaataccagctgattttcagagatggatgattgaaaataaccctgtgaaggaagtcaaggtaatcaatggtgcggaccatatgcccatgttctccaaaccagatgaattatgtcaaaacttgttggaattggctaaaaaacacgcc

SEQ ID NO: 1526 - DNA, 762 bp, Phelline lucida
atggtacacttcgttgcagtccacggcgtttgccatggagcctgggtgtattataagctaaaaccccgggttgaagctgctggtcaccaattcacttcggtgaatctagccgccagtggggtcaacgaaaaaaaattggaagagttgcattcactccatgactacgcgttacctttactggaagtgttagcaagtgttccagaaaatgaaaaagttattctaattggtcatagtggtggaggaatgtcagctgctgtcggtatggaaaattatccagataaaattttagccgcagtcttcttaaacgcgattatgcccgatagtactaatagaccttcttttgtcttggaaaagtacacggctgaaacccccttggaagcctggaaagactcgcaatttggagcctttggtgatccacccatcacctcagtcattgcggggccggaattcctatcggtattatatcatctctcaccagttgaagatttgactttaggtcgtttgttagtgagaccaggttctttattcattgaagaactacttaaatcagataaattctccgaagaaaaatttggaagtgtgaagcgtgtgtacgtcgtttgcactgaagacaaatgcatcccagaggaatttcaaagatggatgattgaaaataatccggtcacagaggttaaggtcattgaaggtagtgaccacatgcccatgttttccaaacctgatgaattgtgccaatcactagttgaaattgcagatacatatgca

SEQ ID NO: 1527 - DNA, 783 bp, Vitex agnus-castus
atggctgggacggagcaaaaaaaacattttgttgccgtccatggtgtcggtcatggcgcctgggtgtattataagcttaaaccacgcatggaagctgcgggttatagattctcgcctataagcttggccgccgccgggaataacggtaagaaattagaagaggtaagatccctgcatgattacaccacgccacttttagaagtcctagcatccgtgcctgacggtgaaaaggtcattctaattggccacagtggtggcggttacgccgccgcttatgctatggaaaagtatccagaaaaaattgccgttgccgtctttttaaatgcgttgatgcctgattctaagaatagaccttcttatgtgattgatgagtatcttaagagaaccccaccagaggcctggatggacactcaatttcctacatatggtgaccctcctattacagccttagtggttggtcccaaattcattagtgaatcactctataatttaagtcccatagaagatcaggctttaggtcatctgtctgtacgtccgggttctctatttatggaagatttagctaccatggacaaattttctgatgataaatttggtagcgttccacgtgtttatgttattgcagctgaagataaaactattccacccgaattccagagatggcaaatcgaaaataacccagtggaagaggtaaaagaaataaaaggtgcggaccatatgccgatgtttactcagcctgatgcactagctaaatgccttggtgaaattgcggaaaaatacgcc

SEQ ID NO: 1528 - DNA, 780 bp, Valeriana officinalis
atgacgaaagatcaaaaacatttcgttgctgtacatggagtctgtcatggggcctgggtttactacaaagtaaagcctagagtagaagccgcaggtcataagttcactgcagtggacttagcggcctccggagctaacgagaaaaatttaaatgatgttacaagtatgctagaatacactaagccccttttggatgtcttggcagctattccggatggggaaaaagttattttagttggccattccggcggtgggatggctgcagcactaggtatggaaaagtttcctgaaaagatttccgtggctgtattcgtttgcgcgatcatgcctgatactactaacacccctagcttcgtgcttgaaaagtattcggcaggtacgccacctgacgcttggaaggactgccaattctcggcaatctcggacccacctatcacgtgtttgtcagttggtcctgaatttctcaaggcgttcctctataccaagtgcccagtagaggactatacccttgctactcttcttgctaaaagaccaggctctctctacattgaggatctaatgaaagccgataaatttaccgaaaagggttttggtagtgtccctagggtatacgtcgtgtgccctgaagatgattgtattcccgctgtctttcaaaagttcatgattgagaataaccccgtcgtagaggttaaagagattccgggcgccgaccatatgcctatgctctccaagcctgatgaattggccaaatgttttgtagagattgctgaaacatacgcg

SEQ ID NO: 1529 - DNA, 765 bp, Stylidium adnatum
atggtacacttcgcagccgttcacggagtgtgccatggttcttgggtttattataaagtgaagccgctagtagaggcagcgggccataaatttactgctatagacctagccgctagtggtgtgaacgaaaaaaagttggaagacctacacagtcttcaggattatacatctcctttattagactttttagcatctttaccaaagaatgaaaaggttgctttgattgggcacagtggaggcggcatgtctgccgctgtcgggatggagaaatatccagataagattttggtggctatttttcttaacgccatcatgccagatacgaaaaatcaacctagctttgtcttagaacaatatagtgcaggaaccccgttggacgcctggaaggatacaaaatttggtgcttatggggacccccccattacatcattatccgttggtcccgaatttatttcttctacattatactcactttctcccaaagaggactttactctgggtacgctcttggttaggcctgggagtttgttcatagaggatttgatgaaggccgagaagtttaccgatgaaggattcggttcagttaaaagagtttatattgtatgtactaaggataaaaccatcccggaagaatttcagagatggatgatcaagaataatcctgtggaggaagtcaaaatcattgaaggagccgatcatatgcctatgttctcgaaaccagctgaactatgccaatgtttggtagaaatcgcgaaaaagtacgcc

SEQ ID NO: 1530 - DNA, 780 bp, Verbena hastata
atggccgcggcgcaacctaagcattttgtcgctgttcatggagtaggtcacggtgcttgggtttactataagttgaaacctagagttgaggcagcaggttacaagtttactccaatttctttagctgctgctggtaataatggtaaaaagattgaagaagtacgtactctaggtgactacactgaaccattgttggaagcattggcagcggtcccagaaggggaaaaagtgattttgattgggcactcaggtggtggctgtgctgcagcttatgcgatggaaaaatatccggaaaagatatctgttgcagtctttcttaacgctattatgcctgacagcaagaataaacctagttatgtgattgatgagtacttagctcgtactcctatggaggcctggatggacacgcaattcgtgcctttaggtgatcctccaatcaccgggttgctatgcggccccaagtttatcagtgaaagtttatataacttgagccctttggaggatcatgcactcggtaacctgtctgtaagaccaggctctttgtttatggaggatgtggccacaatggaaaagttttctgatgaaaaattcggtagtgtacctagagtgtacgtcattgcagcggaggataaaactataaagcccgagtttcagagatggatgatcgaaaataacccagtaaaagaggtcaaagttatagaaggtgccgatcacatgccgatgttttccaagcctgatgagctttgtaaatgtctagttgagattgctgaaaagcatgcc

SEQ ID NO: 1531 - DNA, 786 bp, Byblis gigantea
atggttggtcccacagaaaaacagaaacattttgtcgccgtacatggcgttggtcatggagcgtgggtgtactacaaactgaaaccaagaatcgaagctgcaggatacagattcacaccagtttctttggcagcggcaggtaataatggaaagaaactggaggaggtccgcagtttacacgattacactatgccactattggaagtattagcggcagttcctgaaggtgaaaaggttattttgattggtcattctggtgggggttatgctgctgcatacggtatggaaaaatacccagagaagatctcagtggcagtttttctgaacgctttaatgcccgattcgaaaaacagaccatcttacgtaatagacgagtatttaaagaggacgccaccagaagcttggttagatacccaatttccaacctatggtgaccctccaataacgggtctggtagtaggaccaagatttatatcagagtcgttgtataatctttctcccgttgaagatcaagccctgggccatctaagtgttagaccaggtagtttgttcatggaggatcttgcaactttggataaattttccgatgaaaagtttggatccgtccctcgcgtttacgttatagcagcagatgacatcacgatacctgcagatttccaaagatggctaatagaaaataatccagtgaaagaagttaaggaaattaagggtgccgaccacatgcctatgttcactcaacctgacgcactatgtaaatgtttggttgaaatcgccgagaaatacgct

SEQ ID NO: 1532 - DNA, 783 bp, Pogostemon sp.
atggtgggtgcagcacagccaaaacattttgtcgctgttcatggtgttggtcacggaagttgggtctactacaaattaaaaccaagagtagaagcagcaggatatagattcagtccggtatccttggcggccgcaggtaacaacgggaaaaagctagaagaagtaagatcattacatgattacaccgagccattattggaagtattagcggccgtccccgatggggaaaaagtcattttgattggacattctggtgggggctaccctgccgcttacgcgatggaaaaatatcccgacaaaattgctgtggcagtattcctgaatgctttaatgcccgacagcaagaacaagccttcgtacgtaatagacgaatacttagcacgtacaccaccagagaactggatggatactcaattcgtcccattcggagatccaccaattgtcggcctgttgtgtggacccaactttatcagtcaatctttgtataatttatcaccaatagaggatcaagctctaggtcaattaagtatcagacccggttcactatttatggaagatctcgcaactatggagaagtttagcgacgaaaagttcgggagcgttcctagagtatatgtgattgcaaatgaggacaagacaattcctccggagttccaacgctggcaaatagagaataaccctgttgctgaagttaaggaaataaaaggtagcgaccatatgcccatgtttactcaaccagatgctttggcaaaatgcttggctgaaatagcggacaaatatgca

SEQ ID NO: 1533 - DNA, 783 bp, Strychnos spinosa
atggaaagtgccaaacaaccaaaacattttgtcgctgttcacggggtcggtcatggcgcatgggtgtactataagcttaagccaaggatcgaagcagccggacataggttcacaccggtgaatttggctgcttctggtataaatgagcaaaaacttgaagagatacactccttgcatgaatataccaagccattgttagatgttctagcttctattccagaaaatgagaaggttattttgatcggtcattcggggggaggcatgtccgctgccgtcggaatggagaaatatccccataaaatctcggttgctgtttttttaaacgcaattatgcctgattctaagaatggggcctcatatgtactggaacaatattcagccaggacacctttagatacatggaaggacacgcagttctcgcaatacggagatccaccaattacagctctagtgtgcggaccagaatttattagcactacgctgtatcatctttcacctgtcgaagatcatgctttagggacgttgctagcaagaagagggtcgttgttcatcgaggatctaatgaaagcagagaaatttactgacaaaggttttgggtcagtccctagagtttacgtggttgccgcagaagatcggacgattccaccagaatttcagagatggatgatagaaaacaatcctgtgaaggaggtcaaagagataaaaggagcagatcatatgcctatgttctctaaaccagatgagttatgcaagtgcttggtcgaaatagcaaaaaagcatgct

SEQ ID NO: 1534 - DNA, 768 bp, Corokia cotoneaster
atggtccaattcgtggcggtccacggggcatgtcatggtgcctgggtttactataaacttaaacctcgggttgaagctgcaggtcacaaatttacagctgtgaacttaggagctagcggaataaacgaaaaaaaattagaagaattacactctttatacgattatactttgccgttattagaagtactgggctcaatcccagatggtgaaaaagttgtattgattggtcattccggcggcggtatgagtgctgcgttaggtatggaaaaatatccagataaaatttcggtggcagtttttttgaatgctattatgcctgattctaccaacagaccatcatttgtattggaaaagtacagtgctgagacccctattgaagcatggaaagactctaagtttgctgcttacggtactgatccgcaaataacatcagtcactgtgggtccggaattcatttcatccactttgtaccacctttccccagtagaagactacactctgggtaccttattagtacgtccaggttcgctgtttatagaggacctactgaaagctgataagtttacggatggtggctttggctcagtgaagagagtttatgtagtttgtacagaagatagaactatccctgaggaatttcagagatggatgatcaaaaacaacccagtcacggaagttaaggaacttaagggtgctgatcatatgcctatgttttctaaaccagatgcgcttagccaatgcctaaatgaaatcgcggagacttacgcg

SEQ ID NO: 1535 - DNA, 774 bp, Oxera neriifolia
atggcacaacccaaacaatttgtggctgtacatggtgtaggccatggtgcttgggtctactataaactgaaaccacgaatggaggctgccggttatagattctcccccatttcgttggccgccgcagggaattccggtaagaaattagaagaagttagaactctacaggattatacaacacctttgcttgaagcgttagcagctgtacctgaggatgagaaggttgttttaataggacatagcgggggcggttacgccgctgcttgcgctatggagaaatgtcccgaaaaaattgccgttgctgtttttttaaacgcattgatgccagattctaaaaataggccatcttatgttattgatgaatatttggccagaacaccacctgagaattggatggatacacaattttccacctccggagacccacccataggtgctctactatgtgggcctaaatttatctcggaatctttgtacaacttgtctccgatagaggatcaagctcttggccatttgtctgtccgtccaggcagtttgttcatggaagacctagctaccatggataagttttccgatgaaaaatttggttccgtcccccgtgtttatgttattgcagccgaggataaaactattcctccggatttccaaagatggcaaattgagaacaaccctgtggcggaagttaaagagattaaaggtgcagatcatatgcccatgtttacacagcccgatgcattggcaaaatgcctggcagaaatcgccgagaaatatgct

SEQ ID NO: 1536 - DNA, 786 bp, Buddleja sp.
atggctgctgccgcggtacccccacaacattttgtcgcagtccacggggtaggacatggagcgtgggtctattataagttaaaacccagaattgaagcggccgggcaccgatttaccccaatctcgttggccgctgctggcaactctccgaagaagctagaagaagttaggtccttgcatgattacacagtgcctctactagaagttttggctgaggtgccagaagatgaaaaggttattctaatcggtcacagtggtggaggatacgctgctgcgttcggtatggaaaagtacccagagaaaataaaggttgcagtttttctcaacgctctaatgccagactccaagaataaaccctcctatgtcattgacgaatatctggctaggacccctcctgaagcgtggatggatactcaattcccctcatacggtgaaccgccaataactgctttagttgtaggtcctaaatttatttcggaatcactgtataacctatcaccaatagaggatatagctctgggccatttgtcagttcggccaggttcactttttatggaggatttggcaactatggataaattttctgacgataagttcggatctgtaccgcgcgtttatgtcatcgccgcagaagacaaaacaattcctccagactaccaaaggtggatgatagagaataacccggttgaagaggtcaaagagataaaaggtgctgatcatatgcctatgtttactcagccagacgccttgtgtaaatgctttgttgagattgcggagaaatatgcc

SEQ ID NO: 1537 - DNA, 774 bp, Gelsemium sempervirens
atgcaacaaaagcattttgtcgctgtccacggtgcatgtcatggcgcttgggtctactacaagctcaagccaaggatagaggccgcaggacacagactaacacctgttaacctaggtgcttcaggcataaatgagaaaaagcttgaggaaatccactccttagatgaatacactgcaccactacttgaagtattagccagcatacccgaaaacgagaaggtgattctcattggtcattctggaggaggaatgagcgctgctgtgggtatggaaaaatatccggagaagatcagtgtcgcaatttttctaaatgctattatgccagattctaagaataggccatcttacgtgttggaacaatatactgcaaggactccacttgatgcctggaaagattcacaattcagcgcctatggcgacccacccataacctctctagtttgtggtccagaatttatatcttccacgctctaccatttatctcctgtagaagatcatgcactcggacgcttgttggtacggccaggatctctattcattgaagatctgttgaaagctgataagtatttcactgatgaaggatttggttctgtacctcgtgtgtatgttgtcgcaactgaagacaggacgattccccctgaattccaaagatggatgattgaaaataatcctgtcaaagaagtaaaagaaataaaaggtgctgaccacatgccgatgtttagcaaaccagatgaattgtgtcaatgcctggttgaaatcgcaaaaaagtatgca

SEQ ID NO: 1538 - DNA, 777 bp, Utricularia sp.
atggctgcagtacagaaacatttcctcgcagtgcatggcgttggtcatggagcatgggtttattacaaactaaagccaaggatggaagcggcagggtacagattcagccctatatcgctagcagcagctggtaactcagtaaagaaactcgaggaagtacgttctttgcatgattatacaactcctttgttagaggaattagcggctgtaccagacggtgagaaagttgtcctgataggacatagtggtggtggaattgcagctgcatatgcggcagaacaataccctcagaagattgcggtcgcagtgttcctcaacgctttaatgcctgataccaagaatagaccatcgtttgttattgaagaatatatgaagaggacacccatcgaggcttggttggatactcaatttcccacctacggagatcccccaataactgctttggtagtcggacctaaattcatatctgagtcattgtataatctatcgccgatagaggatcaggctcttgggcacttatccgtccgtccagggtcattgtttttggaagacatggctacgttaccaaatttttctgatgataaatatggttccgttcccagggtttatgttatcgcagctgatgacaagaccattcctgcagactttcaaaggtggcagattgaaaattaccccgttgcagaagtcaaggagatcaaaggtgcagatcacatgccaatgtttacgcagccagacgcattagcgaaggcactgtctgaaattgcagataaatttgca

SEQ ID NO: 1539 - DNA, 768 bp, Scaevola sp.
atggttcaatttgtagcagtacatggtgcttgtcacggagcttgggtctattacaaaattaagccaatggtcgaggctgccggtcacaaacttactgccgtaaatttagccgcttgtggaaattcagacaaaaagctgtcagagttgaacagtttacatgattacactctacctttgctagaagttctagaggcggttcctgccggtgaaaaagtcgtgctaatcggtcactctggtggtggaatgtcagctgcattaggcatggaaaaatatccagaaaaaatcgctgctggcgtctttatatgcgcgatcatgccagattctatcaatagaccctcctttgtactggaaaaatataccgctggaactcccccagaagcctggaaagattcaactttcggtgcatttgggtcggaagtccaaataacatccgtgaccgttggtccagagttcctgaaaacgaatttatatcagttgtgcccggtggaggattttaccctagctactttatcagttcgtcccggcagcatattcattgaagatctattgcgtgcagagaaatttacagacaagggcttgggctctgtgaaaagggtgtatgttgtatgtcctgaagacaaatgtatccctgccgaattccaaaaatggatgatcgaaaataatccagttacggaagttaaggaaattaagggtgccgatcacatgcccatgttctcaaaaccagctgaacttactaagtgtttaattgagatcgcagaaacatacgcc

SEQ ID NO: 1540 - DNA, 768 bp, Menyanthes trifoliata
atggtgcaatttgtggcatgtcatggtgcatgtcatggtgcctgggtttattataagcttaaacctttggtagaagccgcaggacataaatttactgctgtgaatctggccgcatctggggtcaatgaaaagaaactcgaggaagtacactctttacacgattacactttaccactattagaggttttggcagatgtaccagaaggtgagaaggtgatattaatcggccactcaggtggtggtatgtcggctgcggtcgctatggaaaaatatccagaaaaaatctcagttgctgttttcttaaacgcaattatgcctgattcaaagaaccgtccgtctttcgttttagaaaaatacggttcaggtactccgctcgaggcctggaaagattcgaaatttggtgcttatggcacggaccctcagataactacagtcttggtgggaccagagtttatcaagtctaccctttacacgctttgctccgatgaagacatcaccctggggaatcttttagttagaccaggtagtctattcatcgagccacttttaacagcagagaaattcacagacgaaggttttggaagtgtaaaaagagtatacattgtggctacagaagataaaactatacctgaggaattccaacgctggatgattgaaaataatccggtcaccgaggttaaagaaataaagggtgctgatcatatgccgatgttttctaaaccagctgagttgtttaaaagcttagtcgaaatcgcagaaacttatgct

SEQ ID NO: 1541 - DNA, 780 bp, Pinguicula caudata
atggcagcagctcaacctaaacagtttgtagctgttcatggtgtaggacatggtgcttgggtctactataagcttaaaccaagagttgaggctgcaggatacaggttcactcctatttcactagcagcagcagggaataatggtaaaaagttagaagaggtaaggtccctacatgactataccgagccattactagaggcactggcagctgtcccagagtctgaaaaggtaatattaattggacattccggtgggggttacgcagcagcctacggtatggagaaatatcccgagaaaatttctgtcgcagtgttcttgaacgccttaatgccagacagcaagaataggccttcttacgtaatcgatgagtacttaaagaggacaccagcagaggcatggctagatacgcaatttttgccctacggtgatccgcctatcatctctcttatttgcggtccaaagttcatttcagaatcgttatataacctgagtccacttgaggatcacgctctgggacatttatcggtcagacccggctccctcttcatggaagatttggccacgttacctaattttagcgatgaaaaattcggtagcatacccagggtctacgttattgctagcgacgacaaaaccattccacctgactttcaaagatggcagattgaaaacaatccggttgctgaagttaaggaaataaaaggtgctgaccatatgccaatgtttactcaacctgatgcgttaacaaagactttggtagagattgcggagaaatttgct

SEQ ID NO: 1542 - DNA, 780 bp, Psychotria ipecacuanha
atggcagctacccaacagaaacactttgtagctgttcatggtgtaggtcatggcgcttgggtttactataagttaaaaccacgaattgaagctgcaggacatcgcttcactcccgtagatttagcagcggcaggtgtaaacgatactaaacttgaagagttacattctctctgcgattatacgaagcctcttctggatgtattagccgccgtgccagaaaacgaaaaagtcattctaataggtcattccggtggaggcatgtcagctgccgtaggtatggaaaagtacccaaataaaatttctttagctattttcttgaacgccattatgcctgatgctaagaatccaccttcgcatgccttagagcagtattcagcacgtactcccttagacgcttggaaggatactaaattttcggcatacggggatccaccaataacaacattgctagtcggcccagaatttatttctaccacattgtaccatctatctcctaaagaagatcaagctttgggtaatcttttagcaagaccaggcagtctcttcattgaagatctgctaaaagccgataagtttacagaaaaagggttcggctcagtcccaaggacatacgtcattgctgcagacgacaagacaatccctgctgacttccagcgttggatgatcgaaaacaatccagtgaaggaagtcaaagaaattaaaggcgcagatcacatgcctatgtttagtaaacctgacgaattatgcttaacattaatggaattagcaaaaaaatacgcc

SEQ ID NO: 1543 - DNA, 777 bp, Dipsacus sativum
atgccaactcagcaaaaacattttgtggctgtccacggtgtatgtcacggatcttgggtctactataaactaaagcctagggttgaagcagctggacatcaattcacagcagtaaatctcgcagcatcaggtgttaacgaaaaaaagctagaagaagttacttccctggatgaatataccaagccattatatgaggtgcttgcagcagtgcccgaaaatgagaaggtgatcctggtgggtcactcaggaggtggcatggcggcagctttaggtatggagaaatacccagaaaaaattagcgttgcagtcttcgtatgtgcaattatgccagatagtactaatagtccatctttcgttttagagaagtattcaggtgggactccaattgatgcctggaaagactcacagtttggtgtgtttggggatccaccgatcacatcaataactgtgggtcctaattttctcaagagcacgttatataccctttgtccagtcgaggatttcactcttgcaactctgatggtgagacctggctccttgtatattgaagacttgatgaaagccgataagttcacagataaaggtttcggaagcgtcccgagagtttacgtcgtatgccctgaagataaaactataccagtcgagtttcaaaaatggatgattgaaaataatcccgtaactgaagtaaaggaaattgtaggtgccgatcatatgcctatgatgtctaaaccagatgaactgtgtaagtgtttaggagagatcgctgataaatatgct

SEQ ID NO: 1544 - DNA, 774 bp, Exacum affine
atggcacctaagcattttgttgccgtgcatggcgtcgggcacggtgcatgggtatactataagctaaagcctagaattgaggccgccggccaccaatttactgccatcgaccttgcggcagcgggcgttagtgaaaaaaaactagaagaagttcattctttgaatgactatgttgctccgcttttggatgcgcttgcgtcagttccagaaggggaaaaagttattttggtcggacatagtggtggaggattgagcgctgccgttggtatggaaaagtatccagaaaagatatctgtggctgtattcctaaacgcaattatgcccgacacaaaaaatagacctagttatgttatggaagaatacaacgcgcgtacgccacttgacgcatggaaagatactaagtttttaagctatggcgaccctccattaaccgcactgctttgcggtcctgaatttattagctcttctttgtaccacttatccccggtcgaagaccatgccctcggtaaacttttagtgaggcccggcgcattatttgttgaagatttggtaagaggcgacgtgactttcacggaagaaaaatttggttctgtacctcgtgtgtacattgtagcaaaagaagatagaacaatcccggctgactttcaaagatggatgatagagaataatccagtgaaagaggttaaagagattgaaggatccgaccatctgcctcagtttacgaaacccgatgaactgtgccagtatttggtcgatatagcgaacaagtatggc

SEQ ID NO: 1545 - DNA, 771 bp, Chionanthus retusus
atgccaaaagcccactttgtcgccgttcacggcgttggacatggtgcttgggtatactataaattgaaacctagaatcgaagcagccggtcatcgcttcacggccctaaatttagctgcagcaggagtaaatgaaaaaaagctagaggaagtgaggtctctatctgaatatactactccgttgctagattttctagcatctgttccagaaaacgaaaaagtaatattgatcggacattcaggtggtggtatgagcgccgcggttggcatggaaaaatatcccgaaaagatactagttgcagttttcttaaacgccattatgcctgattcaaagaattcgcctagttacgtactcgagcaatactctggtaagacccctctcgatgcatggttagatacacaattctctgcatatggtgatccacctattactgctctaacggtgggcccaaaatttatatcaaattcactttatcatttgagccctgtagaagaccatgcattgggcgaactgttagtcaggagaggaagtttgttcatcgaagacttattacaagccgataaattcacagatgaaaactttggttcagtaccgagggtttatttcgttgccacagaggatagaactattcctgctgaatttcaaagatggatgatcgaaaacaatccagtagaagaggttaaggagattaaaggagcggatcatatgcccatgttttcacagcccgacgagctttgtaaatgtttggttgaagttgctgaaaagtacgct

SEQ ID NO: 1546 - DNA, 765 bp, Allamanda cathartica
atgaaacattttgtcgcagtgcacggcgcaggccatggtgcctgggtttattacaaattaaaacctcgcattgaagctgctggctacagatttaccccggtgaacttggcagcatccggtatcaacgaaaagaaattggtggaagttcgttcgttggatgagtacactaaaccactcctcgatgttttagcttctgttccagaagacgagaaggtcatcttgattggacactccggtggaggcatgtctgcagcagtagggatggaaaagtttccaaagaagatctcgatagctgtcttcctgaatgctatcatgccagatgccaaaaatcgcccatcctatgttttagaggaatacaccgcaagaacgccccctgatgcttggaaggattcacaattcagtgtttacggtgatcctccaataacttctttaatctgtggtccagaatttatatcttcgacattgtaccatcttagtccaattgaagatcatgctttgggaaacctactagttagaccgggtagtttgtttatagaggacttactaaaggcagaaaaattcacagaggaaggctttgggtctgttcctagagtttacgttatagctgcggaggataagactatcccacctgaattccagcgttggatgattgaaaataatccggtaaaagaggtaaaggagattaagggagccgatcacatgcccatgttttcaaaaccagacgagctctgtaagtgtttattagagattgccaagaagtatgca

SEQ ID NO: 1547 - DNA, 780 bp, Phyla dulcis
atggccgcagctcaacctaagcatttcgttgcggttcacggtgttggtcatggcgcttgggtttattacaaactaaaaccccgtgtggaagccgcaggccataggttcactccaattagtcttgctgcggctggaaatgacggtaagaagatagaggaggtcagaacacttcacggatatacaacccctttgcttgaagctctagcagccgtacctgaaggagaaaaagtgattcttgtcggtcattccggtggaggataccccgccgcatacgctatggagaagtacccggagaaaatctctgttgcggtattccttaatgcattaatgcccgattctaagaataaaccatcttatgtgatagatgaatatttagcgaggactccaatggaagcatggatggatacacaattcttgcctcttggagatccaccaataacgggtttattatgtggtcccaaatttatttctgagtcactatataatcttagcccaattgaagaccaagttctgggccacttgtcagtccgacccggctcccttttcatggaggacttggccactatggagaagttcagcgatgaaaaattcggttccgtgcctcgagtctatgtaatagcagcaggtgatgttacgataaaaccagagttccaaaggtggcaaatagaaaataatccagtcaaagaggtgaaagttattgaaggtgcagatcacatgccaatgttcacaaagcctgatgaattatgcaaatgtctagttgaaatagccgaaaaacacggt

SEQ ID NO: 1548 - DNA, 771 bp, Ligustrum sinense
atgccgaaagctcattttgttgctgtccatggagtcggtcacggcgcttgggtctattataaacttaagccaagaatagaggcagctggacacaaattcactgccttaaacttggccgctgccggtatcaacgatcgcaaactagaggaagttaggtctttaagtgagtataccacccccttgttagactttttagctgctgtaccagagaacgaaaaagtcattttaataggtcactcaggtggtggtatgtccgctgctgtcggaatggagaaataccccgaaaagatcgccgtcgctgtttttttgaatgctatcatgccggattccaaaaactcaccatcatacgtgcttgttcaatattctggcaagacaccaccagatgcttggttggacacacagtttagcgcctacggagacccgcctataaccgcgttgactgtggggccaaaatttatctctaactccctgtaccatttgagtccagttgaagaccatgccttaggagaattacttgtcaggcctggctctttgtttattgaggacttgctccaagctgacaaattcaccgatgaaaaatttggtagcgtaccacgtgtctatattgttgccacggaagaccgtaccattcctgccgaatttcaaagatggatgatcgaaaacaaccccgtgaaagaagtaaaagaagtaaaaggtgcagatcacatgccaatgttctctcaacctgacgccctttgcaaatgtttagtcgaagtagccgaaaaatacgct

SEQ ID NO: 1549 - DNA, 783 bp, Pyrenacantha malvifolia
atggagtcaagcaaacaaccaaaacattttgttgcagttcatggggtatgtcatggagcttgggtttattataaaatcaagcatcttatcgaagctgccggccatagattcacaccagtaagcatggctgcttccggtaactcacaaaagaagttggaagaggtctcgtccttgcatgattacactttacccctcttggaggttttaggcagcttaccagaaaatgaaaaagtcatcctagttggtcattccggtggtgggatgtcagctgccttgggtatggagaaatttccagaaaaaatttcagtcgctgtatttttaaatgccataatgccagacacaagccatggcccgtcatttgttctggaacaatacaccgcaagaactcctttaaacgcctggaaggattcgcaattctctgcgtacggagaccccccaataactagttttgttgtgggtccagaatttatttctagtacattataccatctctcacccattgaagatatcactttgggcaaattgagcgtgagacctggaagtttgttcatggaagacgttatgaaggctgatcgtttcaccgaggaaggattcggatccgtcaaaagagtttatgttgtggctaccgaggacaaaactatcccccccgcctttcagagatggatgatcatgaataatcctgttgaagaggtcaaggagattacaggtgctgaccatatgccaatgttctctaaacctaatcaactctgtaaatgtttactagacatcgctgagaagtacgca

SEQ ID NO: 1550 - DNA, 777 bp, Sambucus canadensis
atgggtaaagaccagaagcattttgtagctgttcatggtgtttgtcacggggcatgggtttattataaagttaaaccaagagttgaggcagcaggacaccgattcacagcagtcaacttggcagctgcaggagttgatcagactaaaccagaagatgttaagagcttgtgtgattacaccaaaccattgctagacgttttggaatcaattccggaaggtgaaaaagtaatactgattgggcactcaggcgggggtatgtccgccgcagttgctatggataaataccctcataaaatatctgtcgcagttttcttgaatgccattatgccagatactgctcatcctccttcttttgtactagaaaagtactctggtggtaccccacttgatgcctggaaggacacacaattttcccaatacggggaacctccggttactgctttactagtgggtcccgaattcatctcatctactttataccatctcagtcctgtagaagatcatacgttaggaacgttgctggtaagacctgggagcttattcattgaagatctagttaagctggaaaatttcaccgagaaaggatttgggtccgtcacgagagtctacgtggttgcaacagaagataagacaattccacctgaatttcaaagatggatgattgagaataatcccgtggcagaagttaaagaagtagaaggtgccgatcacatgccaatgttctccaaacccgatcagctatgcaaatgtttagtagaaattgcggaaaagtacgcg

SEQ ID NO: 1551 - DNA, 783 bp, Leonurus japonicus
atggaagtcctgtcgaaacccaaacattttgtagccgtacatggggttggacatggttcatgggtttactacaaactcaagcctagaattgaagctgcaggttatagattttcaccgataagtcttgctgccgctggtaacaacggcaagaagctcgaggaagtccgatctttacatgattatacagagccactattagaagctcttgcggcagtcccagaaggggaaaaagtagtattagttggtcactctggaggtggttaccctacagcctttgccatggagaaatatccggaaaaaatagctgtcgccgtttttgttaacgctcttatgcccgactcaaagaacagaccttcatatgtgattgaagaatatttaggcaggactccacaggaaaactggatggatacacaattcctgtcttatggtgaccctcctatcagtgctttactatgtggtcctaaattcattacagattccctttacaatttgagcccagccgaggatcatgcattgggacaattgagtgttaggccaggttctttgtttatggaagacttaatgacaatggaaaaatttagtgacgaaaaatttgggagtgtcccacgagtttacgtaattgctgccgaggataagaccattccgcctgagttccagagatggcaaatagagaacaatccggtcgcagaggttaaagaaatcaaaggcgctgatcacatgccaatgtttacgcaacccgacgctttggcaaagtgcttagcagagattgccgaaaagtatgcc

SEQ ID NO: 1552 - DNA, 777 bp, Ajuga reptans
atggcaggtaccccgaagcaattcgttgccgtccacggcgtggggcatggagcatgggtttactataaattaaagccgcgaatggaggccgcgggctttcgtttttctccaattagcctagcagctgcaggtaataacggcaaaaaaatcgaagaagtgagaacattgcatgactacaccaccccactgcttgaagctctagccgctgtacctgaagatgaaaaagttatactgattggtcattcaggcggtggttatgcagcagcatacgctatggaaaaatacccggaaaagatttcagtcgcagtcttccttaacgcgttgatgcccgattctaagaatagaccttcttatgtaatagatgagtatttagcacgtactcctccggaaaactggatggatactcagtttcctactttcggtgacccgcctataggtggtctgatatgcgggccgaagtttatttcagaatctctttataacatttcaccaatcgaagatcaagcactcggtcatttgtctgttcgaccaggctctttgtttatggaagatttagccacgatggaaaagttctccgacgaaaaatttggaagtgtgccaagagtttacgtgattgctgctgaagacaaaactattccccccgatttccagaaatggcaaattgaaaacaatccagttgccgaagttaaagaaatcaaaggggccgatcacatgcctatgtttactcagccagatgccttagccaagtgtctggctgagatagctgaaaaacatgct

SEQ ID NO: 1553 - DNA, 783 bp, Paulownia fargesii
atggtcggaggttcacagcctaaacatttcgttgcggttcacggagtcggacacggtgcttgggtttattataagctcaagccgagaattgaggcagcaggatacagatttacgcccgtatcgcttgcagcagccggtaataatggtaaaaaattggaggaggtgagatcacttcatgattacaccacaccattgttggaggtgttggcttcagttcctgaaggagaaaaggttatcctaatagggcattcaggaggtggttatccggcagcttacggtatggaaaagtacccagaaaagatatctgttgcagttttcttgaacgctttaatgccagattctaaaaacagaccatcttatgtcattgatgagtatcttgcccgtactgcgcctgaggcttggctcgatacgcaatttcctacttatggggatcctcccataacagctctggttgtaggtcctaaattcataagtgagagcctatataacctatctccaattgaagatcaagttcttggtcacctttcggttagacccggttcattgtttatggaagatctggctaccctggataaattctctgatgaaaagtttggttctgtacctagagtttatgtcatagccgctgaagataagaccattccaccggattttcaaaggtggcttattgaaaacaatccagttaaagaagtcaaagagattaaaggtgccgatcatatgcctatgtttacacagccagatgctttgtgcaaatgcttggtcgaaattgcagaaaaacatgca

SEQ ID NO: 1554 - DNA, 789 bp, Caiophora chuquitensis
atggcacttgaaaagcaacaaaaacatttcgtcttaacgcacggagcatgccacggcgcttgggtttggtacaaggttaaaagtaaaattgaagccgctggtcataggtttaccgcggtaaatttgggtgcttcaggggtgaatacaaaaaaattagaagaagtttggagcttgaaagattacaccgaacctcttctagaggttttagggagtattcccgaggatgagacagttatattggtaggtcattctgggggcggcatgtctgtcgctctggctatggaaaagtatcctaacaagatttcggttgccgtattcttgaatgcgattatgccagattccacaaatccgccttcctttgtgttggataaatactctggaggcactccacccgaagcttggaaggacactcaatttttatcttttggggacccaaagaaaccacagaccggcctaatcgtcgggccacaattcttaaagtccaccttataccatctatgttccgacgaggattttactttgggaaccttactggttcgtcccggcagcttatttctagaggatttgccgaccctagaaaagttttcggatgaggggtttggatcagtcaagagggtctatattgtctgtgatgaggacaaaacgataccggtagaatttcaacgttggatgatagaaaactctcccgtatcggttgttatggaaattaacggtgctgatcacatgccaatgttttcgaagcctaatgaagtatgtcaaagtttattagaaattgctgacaagcacgca

SEQ ID NO: 1555 - DNA, 783 bp, Plantago maritima
atggtaggtgaagttcaacctaagcaattcttggctattcacggtgtaggtcatggatcttgggtctattacaaagtgaaaccaagaatggaagcactaggatataaatttactccaattagtttagccgctgctgggaactcaccgaagaagttggaagaggttcgatcattgcacgactacactacaccattacttgaagctctagccgctgtcccagagggagagaaggccgttctcattgggcattctggaggtggttatgcagctgcttatgctatggaaaaatatccagaaaaaattgcagtggcagtattccttaatgctctaatgcctgacaccaaaaatagaccaagtttcgtcattgatgagtacttgaaaagaactccaatagaagaatggatggacactcagtttcccacatacggcgaacctccaataacagctctcatctgcggaccaaagttcataagcaaaagcttgtataatctaagccccatagaagatcaagcacttgggcatttaagcataaggccaggttcgttatttatggaggacttggcagtgcttccaaatttcactgaagaaaaatttgggtcagttccacgagtttactttattgccgctgacgataaaactataaaacctgacttccagagatggctcatagaaaacaatccagttaaagaggtaaaagaaataaagggagctgaccatatgccaatgttcacacaacctgacgaactgacaaagtgtttggcagaaattgctgaaaaatatgct

SEQ ID NO: 1556 - DNA, 783 bp, Antirrhinum braun
atggttggtgaagtccaaccgaaacatttcgtggctgtccatggcgtcggacatggtgcatgggtatactacaagttgaaacctaggattgaagctgctggccataagtttactccgataagcctagctgccgcaggcaattcaaacaaaaaaatagaggaagtcagaacccttcacgattacactgaacctctgcgtgaagctttggctgctgttccggaaggcgagaaggtaattttgataggccatagtggaggcggctatgctgccgcctttggaatggaaaagcatcccgagaaaatcagtgtagctgtgtttttaaacgcattgatgccagattctaaaaacagaccgagctatgtcatcgaagaatacttgaagaggacgccacccgaagcctggatggatactcagtttcctacctttggagatccacccattggtggtttgttgtgcgggccaaaattcattagtgaaagcctttacaatttaagtcctatagaagatcatgctcttggtcatttaagtatcagacctggatctttgttcatggaggaccttgcgacaatggacaatttctccgatgacaagtttgggagtgttcctagaatctatgtcattgcggctgatgacaaaacgattcctccggaattccagaagtggcagatagagaataatccagtagtcgaagtcaaggaaataaaaggtgccgaccacatgcccatgttcaccaaacctgatgaattatgtaaatgtctggttgagattgccgaaaagtacgct

SEQ ID NO: 1557 - DNA, 783 bp, Cyrilla racemiflora
atgggtggtgttatgcagcagaagcactttgttgctactcatggcgtcgggcacggttcctgggtttattataagctcaagcctcgcattgaagctgctggtcatagactgactcctgtggatcttgctgcaagtggagttaacgaaaaaaaattagaagaagtcttgactttggatgaatatacaactccactactcgaagtgttagcctcgatccctgagaatgaaaaagtcgtgttaataggtcattcaggtggaggaatggctgccgcagtcggtatggaaaagtaccctgagaagatagccgtagcggttttcctgaacgccataatgccagactccaaaaatcgtccgagttatgtccttgagcaatacagtgccaaaactcctttggacgcatggctcgacacgcaattctcaacctacggttgtccttctatcacttctttgttggtcggtcctaaattcatatcatctagcctataccacttgtcgccagtcgaagatcaagctcttggtactctgttaatgagacctggctctctttttattgaagatctattgaaggctgataacttcactgatgaaaagttcggttctgttcctagagtttttgtagttgcgactgaagataaagttatccccccggagtttcaaagatggatgattgaaaataatcccgttaaagaagttaaagagataaaaggttccgaccatatgcccatgttctcgaaacctgatgaattgtgtcaatgcttagtcgagattgctgaaacctatgca

SEQ ID NO: 1558 - DNA, 792 bp, Hydrangea quercifolia
atggaagtagtcaaacaaagtaaacattttgtgttagttcacggttcatgtcacggtgcatggtgttggtacaaaatcaaacccagactcaaatcggctggtcatagagttacgacccttgatttggcagcatccggaattaacacaaaagaagtacaagaaatttacacattgagggaatattctaagcccttattagagattatggaaagcattgaggaagatgatcaaaaagtaattctggtgggacattcttatggagggatgtcgttagctctggcgatggatatgtatccccacaagatttccgttgcggtctttatggcagcttttatgcctgatacggttcatagaccttctcatgttttagataaatacaccggtgggacaccgttggaagcttggaaggatactcaatttttggcatttggcgatcctgagaagccacagacaggtttaatttttggtccagagtttctcaagaccactctataccatctctgttcagttgaagacttcacgttgggtacgttgctcgtacggccagggtcactttttatggaagatttacatacgcttggtaagttaaccaatgaaggttttggtagcgtcactagagtctatatagtttgcgatgaggacaaaaccattcccgcggaatttcaacgatggatgatagaaaataatccagttacagaagttaaagaaatcaacggtgctgatcacatgcctatgttctcaaagcctaatgaagtattccaatgcttattagaaattgccactaaatatgct

SEQ ID NO: 1559 - DNA, 786 bp, Cinchona pubescens
atggcggctacaaatcaacaaccaaagcattttgtggctgtccatggagtgtctcacggcgcttgggtatattataagctgaagccaagaatcgaagccacaggacataggtttacaccagtagacctagctgcttctgggaaaaatgaaacaaagcttgaagaactccattcaatcactgattatactaaaccgctgcttgaggttttagcaagcgttccagaaaatgaaaaagtcgtgctcgttggccattcgggtggtgggatggccgcggcagtaggtatggaaaagtacccacataaaatttctttagcaatttttttgaatgctattatgcccgacaccaaaaacagaccttcgtacgttttggaacaatactctgctaagacacctcttgacgcttggaaggatactcaattctttgtttacgacgatcctccaattaccgcaatgaccgtgggtcctgaattcatttcttcaacattgtatcacctttctcccaaagaagatcacgcactaggcaaattactagttcgacctggtactctcttcatggaggatttggtgaaactagacaattttaccgataaaggatttggttctattcctcgtgtatatgttatcgcaggtgacgacaaaaccatcccacctgactttcaaaggtggatgattgaaaataatcctgttaaggaagttaaggagattaaaggtgccgaccacatgccaatgtttactaaaccggatgtattatgtcaatgtttgctagaactagctaataagcatgcg

SEQ ID NO: 1560 - DNA, 789 bp, Actinidia chinensis
atggaagttacaaagaagaagttgcatttcgtgggaactcacggtatgtgccaaggggcctggatatggtataaggtaaagccccgggtagaggctgctggtcacaggttcacagctgtcgatttaggtgcttgtggtaggaacccaaagaccttagatgaagtccggacattatacgattacaccttgcctctcttagaggcactagcttctattccagaaaatgaaaaagttgttttggtgggattttcaggggggggattctctgccgcagtggcgatggagaagtatccgaaaaaaattgctttagcaatctttttaaatgcaacaatgccagatacaactcatgaggctagctacgtccttgaccaatacgcattagggatctcaggtgacacgtggaaagatacacaattctcaacttacggtgatccaaatgagccacttacatcattattggttggacctaagttcatgaagtcaactacctttcaacactgttctattgaagacttgacattagctaccatgctagttcggccaggttcattattcatggaagacttaaaaaaagcaaagaagtttactgatgaaggtttcgggtctgttaaacgagtctgcgtgttgtgcgaacaggatctttgtttaagtgctgagtttcaacgttggatgatagaaaataatcccgtagaagaagtagccgcaatagagggagcagatcacatgattatgttctctaatcccgaaaaattgtgcgaagttttactggaaatggctcagaaacatact

SEQ ID NO: 1561 - DNA, 777 bp, Swertia japonica
atgtcctcaaataaacacttcgtagcagtccacggtgtaggtcacggagcttgggtttattataaattgaaaccgcggatagaagccgcgggataccgatttacagcaatagatttggcagctgccggagtatcatcgaaaaagctggaagacattcactctctcaacgaatattgtgagcccctattcgacgtgctttccagtgttccagaaaatgaaaaagtgatattagttggccatagcggtggtggattgagcgcagcattgggaatggagaaatattcagaaaaaatttccgttgcagtatttttaaatgctattatgcccgatactaaaaacagaccttcttatgtgatggaggaatacacggctcgtaccccaattgaagcgtggaaagacaccaagttctcagcctatggtgaacctcccataacagccctgttatgtggacctgagtttatttctacctcactctatcatcttagtccagttgaagatcatacgctcggtaagctattggttagacctggagcattgtttgtcgaagatctaatcaaaggtgaagttaagtttacagaagaagggttcggatctgtaccaagagtatatgtggttgctactgaggacaaaactattccagctgagtttcaacgctggatgatagaaaataatcctgttaaagaggttaaagaaatcgagggagctgaccacttgccacaattcagtaagccagatgaattatcaaaggttttagtagacattgctaagaattacgga

SEQ ID NO: 1562 - DNA, 783 bp, Sesamum indicum
atggcagccgcagctaaatctaagcatttcgtagctgttcacggggtcggtcatggcgcatgggtatactataaacttaagcctagagttgaagcggctggataccaatttacaccggtatcgcttgcagcagccggaaataacggtaagaaattggaggaagtgcgaagccttcatgactacacaacacctttgttagaagtattagctgccgtaccggaaggtgaaaaggtaattttaataggccattcaggaggcggatacgctgctgcctatggcatggaaaaatatcccgagaaaatctccgttgcagtctttctgaatgctctgatgcctgattctaaaaataagccttcttacgttatcgacgagtacctggcgcgaactccaccagaagcttggatggacactcaatttccaacctacggcgaccctcctattacagctcttgtagtcggtccaaaatttatctccgaaagtttatacaacttatcaccactggaggatcaagctttgggtcacttgtctgtgaggccgggttcacttttcatggaagatctagcaaccatggataagttttccgacgaaaagttcggtagtgtgccaagagtgtatgtgatagccgcagaggacaaaaccattccgccatcattccaaaaatggcaaatcgagaataatccagttgttgaggttaaagaaatcaagggagccgaccatatgccgatgtttacccaacctgatgcgctgtgcaaatgcctagtagagattgctgaaaaacatggt

SEQ ID NO: 1563 - DNA, 966 bp, Isodon rubescens
atggcctcaagggagggcgaagttgtttgtgttacaggtgggtcaggttttataggctcctggatcgtgcatttactgttacgtagaggctacactgttcgggctacggtgaagaatttaggagatgagcgcgaaactaaacatctggaagctattgaaggagccgacagtagactccgattgtttcaaattgaccttttggattatgattcggttgcagccgctgtgtcgggcgccgcaggcgtcttccatttggctagcccttgcgtaatcgatcaagtgcacgacccacaaagagagttgttagaccctgcaattaaaggtacgatcaacgtcttaaccgcagccaaggcacttggcgtccgtagggtagttatcacatcatcgatttcagctatgattccctcttcaaataatttggctgatgttggtgaggactcatggatcgatgaagattattgcagacaaaatggtctgtggtatcccttaagtaaggcactagccgaaaaagcggcttggaagtttgctgaggagaatggtctggatattgttgtcgttaacccgggtatggttgtcgggcctattaacccgcctgctttaaattcttctatgcaattgatgctacgagttttacaaggaaatgatttttttgaaggtttctttatggctttggtccacgttaaagacgtcgccttagcacaccttcttttatatgaaaatacctcggccgctggtaggcatctatgcgtagaatcactaagtcgttatgatgatttcgctgagaaaatgggcaagctgtatcctgaatacaaactaccccgtccttcatctaaggatactcaacacggctctctcaagtcagatgctgctttgaaaaaactaaaggatctaggattggaatttataccactggagcagatgataaaagacagcatagagtcattaagatccaaaggctatatctct

SEQ ID NO: 1564 - DNA, 966 bp, Prunella vulgaris
atggctaacaaagagggtgaagtggtttgcgtaacaggtgcttcaggtttcataggtagttgtctagtgcatcatttaatcaacaggggttacactgtaagagccaccgtaaagaatctagcagacgaaagggaaactaaacatctagaagcaatagaaggagctcatagtagattgcacctgttccagatcgatttattagattatgatagtatagctgccgcggtctcaggtgccgctggggtttttcatctggctagtccatgcgttattcatagggttgatgatccccaacgggaattgttagatccagccattaaagggacagtaaatgtactgaaagcggcgaaaaacctcaatatacgcagagtagtcgtgacgagttctatttccgccatgatagctagttcttccagtttagctgatgtaggtgaagattgttggattgacgaggatttctgcagacaaaatggcttttggtacccattatctaaagctctggccgaaaaggccgcatggcggttcgctgaggagaacggtttggacattgtcgtaataaaccctggcatggtagttggcccaatcctgccacccgccttgaattcttctatgcaactaatgttggatgtgttgcagggaaaggatttttcggaaggcttttttatgaccctggtgcatgtgaaggatgtcgctcttgcccaaatcctgttatatgaaaacaccagtgccactggccgtcacttatgtgtcgaatcgctctctagatacgatgattttgccgagcagatggaaaaactttatcctgaatacaagttgccaagattctctaatgatcatacacaggacgaatcactaaaatccaacgccgcattgaaaaagttgatagacttaggtatggaatttacgccacttaaacaaatagtaaaggaatcaatagaatctttgaggtctaagggatacttgtcc

SEQ ID NO: 1565 - DNA, 963 bp, Agastache rugosa
atggcaaataaagaaggtgaagttgtctgtgtaactggaggtagcggatttattggaagttggttagttactcttttgttaaggcgtggttattctgttagagccacagtcaaaaacctaggtgatgaaagggagactaagcatttgggcgcgatcgagggtgcagatagtagattgagattatttcaaatcgacttgttggattacgattctatagtagctgcagtcgccggcgccgcgggtgtctttcacctcgcttccccctgcgtaattgatcaggttagagacccacagagagaattactagatccagctataaaaggtaccctgaatgtattgacggcagctaaaaatttggatgtaagacgagtagtggtgacttcaagtattagcgcgatgattgcaagcagtaattccttggctgagactggtgaagactgttggatcgatgaggattactgtcgtcagaatggtttgtggtatcctctgtccaaagcattggctgagagagccgcatggaaatttgctgaagagaatggactagacattgtagttgttaatcctggcatggttgttggtccgattttgccaccagccttgaatagttctatgcaaatgattttgcgtgctttacagggtaaagattttccagagggtttttttatggctcttatccacgtgaaagatgttgccttagctgaaattttgctgtatgagaacacatctgcagcaggccgacatttatgtgcagaatcattatcgcgctacgatgatttcgcggaacaaatggaaaagttatatccggaatacaagctgcctagattcgcaaacgacacgcagagaggttcacttaaatcaaatgccgcattaaaaaagttgatcgatttgggcttggaattcacccctctagaacaaatcgttaaagattctattgaatcgctaagaagtaaaggttatatttct

SEQ ID NO: 1566 - DNA, 966 bp, Melissa officinalis
atggtaatatccgaagagggagaggtggtctgtgtcaccggagcatcagggtttataggttcttggctggttcacttattgttgaggagaggctatactgttagagctactgtcaaaaatataggagatgaaagagaaacgaaacatcttgaagccttggaaggcgctgattctagattgagattattccagatcgatttgctagactacgacagtattgttgctgcagtatctggtgcggcaggcgtctttcacttagcatccccttgtataatagatcaagtggaagatcctcagcgtgagcttctggatcctgctattaagggtactatcaatgtattaactgccgctaagaacttgaatgtaagaagggttgttgtgacttcgagtatttcagccatgatagcctccagctcttcgttagcagacacaagtgaggattgctggattgatgaagactactgcaggcaaaacggtctatggtaccccttgagcaaagcgttggctgaaaaggctgcttggcagttcgcaaaagagtcaggtttagacatagttgtagtacatccaggtatggtcgtaggtccaatcatcccaccggcactgaactctagcatgaggctaatgttacatgtattacagggtaaggacttttcagagggattcttcatggctttagtgcacgtaaaggacgtcgccctcgcagaaattatgttatatgaaaacactagtgcagcaggcagacacttatgtgtcgagtccttgtctagatatgatgattttgcagagcaagtagccaaactgtatcctgaatacaaacttccaagatttttaactgacacccaaagagaatctccgaaatcaaatgccgcgtcaatgaagttagttgatttagggatggtttttactcccttagagcaaattgttaaagattcaattgaaagtttaagatccaagggatacctctcc

SEQ ID NO: 1567 - DNA, 963 bp, Micromeria fruticosa
atggtaaataaagaaggggaagtggtttgtgtcactggaggttcaggtttcattggtagttgggttgtgaatctgttattgcgtagaggatacacggtccatgctacagttaaaaatttgggcgacgaatcagaaactaaacacttagaggccttggaaggtgcagattcaagattaaggttatttcagatcgatctattagattatgactctatagtagcagccataagtggggccgctggagttttgcacttggcttctccgtgtactatagtacaagtcgaagatccccagcgagagcttttggaccccgctgttaaagggactataaatgtgctgaccgcggccaagaacttggatgttcgtcgtgtcgtcgtcactagctctatttcggcaatgattgctagttcaaataaccttgctgacgccggtgaagattgctggatcgacgaagactattgtcgacaaaacggtctttggtaccctctttcaaaggtgttagctgaaaaggcggcatggaaattcgcagaagaaaacggcttggacattgtcgtagtcaatcccgggatggttgtagggccaattttcccacccgcgttaaatagttcgatgcaacttatattgaatgtcctgcaaggtaaagatttcccggaaggtttcttcatggccctggttcacgtcaaagatgtcgctttggctctaatccttttgtatgaaaatacgtctgctgctggtcgacatttgtgtgtcgaatcattatcgagatatgatgactttgccaaacaaatggagaaattgtatccggagtataaactaccaagattaagcaacgatactttgctaggtagtccaaaatctaatgccgcttcgaagaagttgatagatctaggtctagagtttactcctctggagcagacggtaaaggatagcattgagtccctgaggtcacgtggttatttgagt

SEQ ID NO: 1568 - DNA, 972 bp, Plectranthus caninus
atggcaagaagagaaggagaagttatctgcgtgactggtggttctggtttcataggttcttggattgtacatttgttgctccatcgaggatataccgtccgagctacggttaaaaatctaggtgatgagcgcgaaactaaacacttagaagctatcgaaggcgctgactctagacttcgattgtttcagattgatctattagattatgattctattgctgctgctgtctctggcgccgctggtgtcttccacttagcgagtccttgcgttattgatcaagttcaagacccgcaacgagaattgttggatccagccatcaaaggaactatcaatgttttaactgctgctaaggagttaggcgttagaagggtggtcattacatcatcaatatcagcgatgatagcaagctccaacaaccttgccgacgttgcagaggattgctggattgacgaagattattgtagacagaatggtttgtggtatcctttatcaaaggtattggctgagaaagcagcttggaagttcgctgaagagaacggtctcgatatagttgcagtccatcccggcatggtcgtaggaccaattatccccccggcattaaattcgtccatgaaattgatgcttcgtgttttacagggagacaacgacttttctgaaggtttcttcctagccttggttcacgtaaaagacgtagctttggctcacctgttgttatacgaaaatacatcagctacaggtcgtcacttgtgtgttgaaagcctatcgtgttatgcagactttgttaagaccatggagaaactttatcctgaatacaagctacctcgtccctcaattgatactcaacatggttctttaaaatcagatgcagctgccgctctgaagaagcttatagatctaggtatggaattcatcccactagaacaaatagtcaaagatagtatagaatctctgaggtccaaaggttacatctct

SEQ ID NO: 1569 - DNA, 960 bp, Rosmarinus officinalis
atggcaaacaaggaaggcgaggtcgtttgcgtaaccggtgcaagtggatttataggttcttggatcgttcatttactattaaggcgtggttacgctgttagggctaccgtcaagaatatcggagacgaacgtgaaactaagcatctggaagcaattgagggggctgcgagtagactaaggctattccaaatagatttattggattatgatagtatagctgcggcaatcagcggagctgcgggggtgtttcacgtggcttcgccatgtacaatcgataaagtcgaagatccacaacgtgagttactagatcccgcaattaaaggaactttgaacgttttgacagcagctaagaatctagatgttagaagggtcgtgattacctcgagtatctcagcgatgatagcttcttccaatagcttggcagatgtcgacgaagattgttggatagacgaagattattgtagacaaaatggtctatggtaccctttatctaaagctttggcagaaaaagctgcttggaagtttgctgaagaaaatggtttggatattgtagtggtaaaccctggaatggttgtcggacccatattaccacctgcattgaatagtagtatgcaattaatggtaagagtcctacagggttgtgatttcttcgaaggttttttcatggctctagttcacgtgaacgacgtcgctttggcccacatcttattatacgagaacacttcggcagccggaagacatttgtgcgtagagtcgttatcttcatatgacgattttgcagagttaatggaaaaactttatcccgaatataaactaccaaggttttgtaaagacaagcacggttcggtcaagagtgatgcggcaatgaagaagttaattgacatgggtatggaatacacgccaatggagcaaatagttaacgacgcaattcagtctttacggagcaagggttacctttca

SEQ ID NO: 1570 - DNA, 963 bp, Nepeta mussinii
atggcggataaggagggagaagtggtctgcgtaacgggtggctcaggttttattggttcttggttggttacattgttactgcgaagaggctatagtgtacgcgcaaccgtgaaaaatttgggcgatgaacgtgagactaaacatttagaagctattgaaggtgcagactcgagattatctttgtttcaaatagatctattggattacgatagtgtcgctactgccgtgggtgatgctgccggagtcttccatttagcctccccatgtaccatagatcaggtgaatgatccacaacgggaattattagaccccgctatcaaaggaactttgaatgtgttaaaggctgctaaaaacctaggagttagaagagttgtagtgacttcatctattagcgctatgatagccagttccaactcattggctgagaccggtgaagactgttggatcgatgaggactactgtaggcaaaatggtttatggtatccggttagcaaggcactagctgaaaaagcagcatggaaattcgcagaagaaaacggcttggacatcgttgtggtcaaccctggcatggttgttgggccaatactacctccagctcttaactcttctatgcaattaatgttgcatgttttacagggtaaggatttttttgaaggtttcttcatgggactagtgcacgtaaaagatgtggcattggctgaaattttgttatacgagaacacttctgcctccggaagatatctgtgtgtagaatcattatcccggtacgatgattttgccaagcagatggaaaagttatatcctgagtataagttaccacgtttttcaaacgacacccaacatgggtcgcttaaaagcgatgctgcgctcaagaagcttagagatttgggaatcgaattcgctcccttagagcaaatcgttaaagattcaattgaatcattaagaagtaagggttatatatct

SEQ ID NO: 1571 - DNA, 831 bp, Catharanthus roseus
atggacttcttagccacgtctgagggtcaattttttgttgcggttgcggtctctttagttgctgtaggggttgcttattttgtgctttcatctaaaaaaccaaaagtttgcttgaacccagaaaattttaaggaatttaagcttgttaagaagacccaacttagtcataatgtggccagtttcaaattcgctttacctactccgacctctgtactgggtctcccaatcgggcaacatatttcttgcagaggcaaagattctcagggcgaagaagttataaaaccttataccccaactacgctagacagtgatgtcggttactttgagttagtaataaagatgtatccacaaggccgcatgtctcaccactttcgtgagatgcaagaaggtgattatatggctgtcaagggccccaaaggtagattcaaatatcaaccaggacaagtcagggcgtttggcatgcttgcaggcggttctggtattacccccatgttccaggtcgctcgagcaatccttgaaaatccaaatgacacaaccaaagtccatctaatttatgccaacgtaaccgcggacgatatcttactcaaagatgaattggaaggattaacgaaaaattaccccgacagattcaaagtttattatgttttgaaccaacctcctgaagtgtggaatggtggggtaggttttgttagtaaggaaatgattcaagcacactgtcctgcaccatctagcgacatcaaaatccttagatgcggaccacctcctatgaacaaagctatggctgcgcatttggaggctataggttatgctccagagatgcagttccagttt

SEQ ID NO: 1572 - DNA, 831 bp, Nepeta cataria
atggactttcttgctacaagtgaaggtcagcttgtggttggtgtcgctgttggcctattggctattggagccgcttattttctgttctcccccaaaaaaccaaaagtatgtctggacccagaaaatttcaaggaatttaaactagtaaagaaaacacaactgtctcataatgtagctaaatttagattcgatttgccaactccaacaagtgtcttgggtttacccataggtcaacatatttcctgcagaggtaaggactcgcaaggcgaggaagtaataaaaccttatactcccacgacattagattccgatgtaggatattttgaacttgttatcaaaatgtaccctcagggccgcatgtcacaccattttagggaaatgaaggaaggtgactacatggctgttaagggacctaaggggaggttcaaatatcagcctggtcaagtgagagcatttggtatgatagcaggtggtagtggcatcacccccatgtttcaagttgctagggcaattctcgaaaacccgaatgaccgcacaaaggtccaattgatctatgctaatgttacttatgacgacatattattgaaagacgaaatcgattctctagctaagaattatcctgatcaattccaagtgtattatgtattgaatcaaccaccagaagtctggaatggaggggtcggttttgtttctaaggagatgattcaagcccattgtccggccccagcgtcggatgtcaaaatacttaggtgtggtccccctcctatgaataaggccatggcagccaatcttgaggccctagaatattcccctgaaatgcaatttcaattc

SEQ ID NO: 1573 - DNA, 843 bp, Arabidopsis thaliana
atggataccgaatttttaagaacgttagataggcaaatactcttgggcgtctttgtggcatttgtggccgtaggagcaggtgccgcctatttcttaacttcttccaaaaaaagacgagtttgcttagacccagagaattttaaagaatttaagttagttaaaagacaccaattatcacacaatgttgctaaatttgtcttcgaattacctacgtctacttcagttctaggcttgcctattggccaacatatctcgtgcagaggtaaagatgggcaaggtgaagacgtcatcaaaccgtacacaccaacgacattggactcagatgttggacgattcgagttggtaatcaaaatgtacccccaaggcagaatgtcacatcattttagggagatgagagtgggagatcatcttgcagttaaaggtcccaagggtaggttcaagtatcaacccggacaattcagagcttttggaatgttggccggtggttctgggataactcctatgttccaagtagctagggcaattcttgaaaatccgaccgataagacaaaagtgcacctaatctatgctaatgttacatatgatgatattttgttaaaagaggagttagaaggtttgactacaaattatcctgaacagttcaaaatattctatgttctgaaccaacctcctgaggtttgggatggaggggttggtttcgtttctaaagagatgatacaaacccactgtcctgcaccagcttcagatattcaaatcctgagatgcggcccgccaccaatgaacaaggctatggctgctaatctggaagctttgggatattcgcctgagatgcaatttcaattt

SEQ ID NO: 1574 - DNA, 831 bp, Catharanthus roseus
atggattttctggcgacctcagaaggacaattttttgtggctgtcgcagtgagccttgtagccgtcggagtcgcgtactttgtgttgagctctaaaaagcccaaggtgtgcttaaatccggagaactttaaagagtttaagttggtaaagaaaactcaactatcacacaacgtagcttcatttaaattcgcattacctacccctacttccgtccttggcctgccgattggtcaacacataagttgtaggggcaaggatagtcaaggagaagaagtcattaaaccttataccccgacgacacttgatagcgatgttggctacttcgagttggtgattaagatgtacccacagggacgtatgtcccatcattttagggaaatgcaagaaggagattatatggcagtaaaaggtcctaaagggaggtttaagtatcaaccgggacaagtaagggcatttggtatgctggcaggagggagtggtattactccaatgttccaggtagcaagagctatccttgaaaacccgaatgacacgacgaaagtacatctgatttacgcgaatgttaccgctgatgatatattactgaaagacgagttagaaggtttgactaaaaattacccagatcgtttcaaggtctattatgtccttaatcaaccaccggaggtatggaatggtggcgttgggttcgtatcaaaggagatgattcaagcacattgcccagcgccgtcatctgatataaaaatacttagatgcgggcctcctcccatgaataaggcaatggccgctcatttggaagcgatcggatacgctcctgagatgcagtttcagttt

SEQ ID NO: 1575 - DNA, 831 bp, Nepeta cataria
atggatttcctggctacgagcgaaggacagctggtggtgggtgtggctgttggactactagcgattggagcagcatattttttgttctcacctaagaagccaaaggtgtgtctggatcccgaaaatttcaaagagttcaagctggtcaagaagactcagctgtcccataacgtcgcaaaattccgttttgatctaccgactcccacctctgttttgggtcttccaataggccaacacatatcctgtcgtggtaaggattctcagggcgaagaggtgataaaaccatacacgcctacgacccttgattctgatgtcggctactttgagctggtaatcaagatgtacccacaaggtcgtatgagccatcacttcagagaaatgaaagagggagactatatggcggtgaaaggtcctaaggggaggtttaagtaccaacctggacaggtccgtgcattcgggatgatcgctggtggctcaggtatcacccctatgtttcaggtcgcccgtgctattctggagaaccccaacgacagaactaaggtgcagcttatctacgcgaatgtcacttacgatgacatcctattgaaggacgaaattgacagccttgccaaaaactacccagatcaatttcaggtttattacgttctgaatcagccccccgaagtttggaatgggggagtgggtttcgtgtctaaagagatgatccaagcacattgccctgcccctgcttctgacgttaaaatattaagatgcgggccgccgccgatgaataaagcaatggcggctaacctagaggcattagaatacagccccgagatgcaattccagttc

SEQ ID NO: 1576 - DNA, 843 bp, Arabidopsis thaliana
atggacaccgaattcctgagaacattagacagacagatccttcttggtgtattcgtagcttttgtagctgttggcgcaggggcggcctattttctgacatcctcaaaaaagcgtcgtgtttgtctggatcctgaaaatttcaaagagttcaaactagtgaaacgtcaccagctaagccataacgtcgccaagttcgtttttgaattacctacaagtactagtgtactaggacttccgattggacagcacatctcttgcagaggaaaagacggccaaggggaggatgttattaaaccctatacgcctacgaccctagactcagatgtcggcagattcgagcttgtgattaaaatgtacccgcagggtcgtatgagtcatcactttagggagatgagagttggcgatcaccttgcagttaaaggaccgaaggggaggttcaaatatcagccggggcaattccgtgctttcggcatgctggctgggggtagtgggattactccgatgtttcaggtagcgcgtgccatactggaaaatccaactgacaagacaaaggtacatctaatttatgccaatgttacatatgacgatatactgcttaaagaggaactggagggtctgacaactaattatcctgagcaattcaaaattttctacgttttgaaccagcccccggaagtctgggacggtggagtaggatttgtatccaaggagatgatacagacgcattgtccagctccggcgagtgacatacagatactgcgttgcggtcccccacctatgaacaaggcgatggccgctaatctggaagcactaggttattccccagaaatgcagttccagttc

SEQ ID NO: 1577 - DNA, 577 bp, Saccharomyces cerevisiae
ttagtaaaaatgtgcgcaccacaagcctacatgactccacgtcacatgaaaccacaccgtggggccttgttgcgctaggaataggatatgcgacgaagacgcttctgcttagtaaccacaccacattttcagggggtcgatctgcttgcttcctttactgtcacgagcggcccataatcgcgctttttttttaaaaggcgcgagacagcaaacaggaagctcgggtttcaaccttcggagtggtcgcagatctggagactggatctttacaatacagtaaggcaagccaccatctgcttcttaggtgcatgcgacggtatccacgtgcagaacaacatagtctgaagaagggggggaggagcatgttcattctctgtagcagtaagagcttggtgataatgaccaaaactggagtctcgaaatcatataaatagacaatatattttcacacaatgagatttgtagtacagttctattctctctcttgcataaataagaaattcatcaagaacttggtttgatatttcaccaacacacacaaaaaacagtacttcactaaatttacacacaaaacaaa

SEQ ID NO: 1578 - DNA, 660 bp, Saccharomyces cerevisiae
ttgctagccttttctcggtcttgcaaacaaccgccggcagcttagtatataaatacacatgtacatacctctctccgtatcctcgtaatcattttcttgtatttatcgtcttttcgctgtaaaaactttatcacacttatctcaaatacacttattaaccgcttttactattatcttctacgctgacagtaatatcaaacagtgacacatattaaacacagtggtttctttgcataaacaccatcagcctcaagtcgtcaagtaaagatttcgtgttcatgcagatagataacaatctatatgttgataattagcgttgcctcatcaatgcgagatccgtttaaccggaccctagtgcacttaccccacgttcggtccactgtgtgccgaacatgctccttcactattttaacatgtggaattcttgaaagaatgaaatcgccatgccaagccatcacacggtcttttatgcaattgattgaccgcctgcaacacataggcagtaaaatttttactgaaacgtatataatcatcataagcgacaagtgaggcaacacctttgttaccacattgacaaccccaggtattcatacttcctattagcggaatcaggagtgcaaaaagagaaaataaaagtaaaaaggtagggcaacacatagt

SEQ ID NO: 1579 - DNA, 668 bp, Saccharomyces cerevisiae
tatagttttttctccttgacgttaaagtatagaggtatattaacaattttttgttgatacttttatgacatttgaataagaagtaatacaaactgaaaatgttgaaagtattagttaaagtggttatgcagcttttccatttatatatctgttaatagatcaaaaatcatcgcttcgctgattaattaccccagaaataaggctaaaaaactaatcgcattatcatcctatggttgttaatttgattcgttaatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccgtcggagggctgtcgcccgctcggcggcttctaatccgtacttcaatatagcaatgagcagttaagcgtattactgaaagttccaaagagaaggtttttttaggctaagataatggggctctttacatttccacaacatataagtaagattagatatggatatgtatatggtggtaatgccatgtaatatgattattaaacttctttgcgtccatccaaaaaaaaagtaagaatttttgaaaattcaatataa

SEQ ID NO: 1580 - DNA, 668 bp, Saccharomyces cerevisiae
ttatattgaattttcaaaaattcttactttttttttggatggacgcaaagaagtttaataatcatattacatggcattaccaccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactata

SEQ ID NO: 1581 - DNA, 725 bp, Saccharomyces cerevisiae
tttgccagcttactatccttcttgaaaatatgcactctatatcttttagttcttaattgcaacacatagatttgctgtataacgaattttatgctattttttaaatttggagttcagtgataaaagtgtcacagcgaatttcctcacatgtagggaccgaattgtttacaagttctctgtaccaccatggagacatcaaaaattgaaaatctatggaaagatatggacggtagcaacaagaatatagcacgagccgcggagttcatttcgttacttttgatatcactcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcattagatatattttctgtcattttccttaacccaaaaataagggaaagggtccaaaaagcgctcggacaactgttgaccgtgatccgaaggactggctatacagtgttcacaaaatagccaagctgaaaataatgtgtagctatgttcagttagtttggctagcaaagatataaaagcaggtcggaaatatttatgggcattattatgcagagcatcaacatgataaaaaaaaacagttgaatattccctcaaaa

SEQ ID NO: 1582 - DNA, 453 bp, Saccharomyces cerevisiae
cggattagaagccgccgagcgggcgacagccctccgacggaagactctcctccgtgcgtcctggtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatcaacgaatcaaattaacaaccataggataataatgcgattagttttttagccttatttctggggtaattaatcagcgaagcgatgatttttgatctattaacagatatataaatgcaaaagctgcataaccactttaactaatactttcaacattttcggtttgtattacttcttattcaaatgtcataaaagtatcaacaaaaaattgttaatatacctctatactttaacgtcaaggagaaaaaactata

SEQ ID NO: 1583 - DNA, 500 bp, Saccharomyces cerevisiae
tggaactttcagtaatacgcttaactgctcattgctatattgaagtacggattagaagccgccgagcgggcgacagccctccgacggaagactctcctccgtgcgtcctggtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatcaacgaatcaaattaacaaccataggataataatgcgattagttttttagccttatttctggggtaattaatcagcgaagcgatgatttttgatctattaacagatatataaatgcaaaagctgcataaccactttaactaatactttcaacattttcggtttgtattacttcttattcaaatgtcataaaagtatcaacaaaaaattgttaatatacctctatactttaacgtcaaggagaaaaaactata

SEQ ID NO: 1584 - DNA, 500 bp, Saccharomyces cerevisiae
atcgcttcgctgattaattaccccagaaataaggctaaaaaactaatcgcattattatcctatggttgttaatttgattcgttgatttgaaggtttgtggggccaggttactgccaatttttcctcttcataaccataaaagctagtattgtagaatctttattgttcggagcagtgcggcgcgaggcacatctgcgtttcaggaacgcgaccggtgaagaccaggacgcacggaggagagtcttccgtcggagggctgtcgcccgctcggcggcttctaatccgtacttcaatatagcaatgagcagttaagcgtattactgaaagttccaaagagaaggtttttttaggctaagataatggggctctttacatttccacaacatataagtaagattagatatggatatgtatatggtggtattgccatgtaatatgattattaaacttctttgcgtccatccaaaaaaaaagtaagaatttttgaaaattcaatataa

SEQ ID NO: 1585 - DNA, 333 bp, Saccharomyces cerevisiae
cggagcagtgcggcgcgaggcacatctgcgtttcaggaacgcgaccggtgaagaccaggacgcacggaggagagtcttccgtcggagggctgtcgcccgctcggcggcttctaatccgtacttcaatatagcaatgagcagttaagcgtattactgaaagttccaaagagaaggtttttttaggctaagataatggggctctttacatttccacaacatataagtaagattagatatggatatgtatatggtggtattgccatgtaatatgattattaaacttctttgcgtccatccaaaaaaaaagtaagaatttttgaaaattcaatataa

SEQ ID NO: 1586 - DNA, 152 bp, Saccharomyces cerevisiae
cggattagaagccgccgggcgacagcccaatattatttaaggacctattgttttttccaataggtggttagcaatcgtcttactttctaacttttcttaccttttacatttcagcaatatatatatatatatttcaaggatataccattcta

SEQ ID NO: 1587 - DNA, 600 bp, Saccharomyces cerevisiae
tacagggcgtatatatacataacattttaagataagcaagtgaatgttgattcccgtttcttagtcaacacttctttctattttacccggtcgttaccctattaaaaaaacaacttacaatcattgttcgccccttccatacttactgccactcgcaaaagggcccaaccagggcaattacgtatcaaaaaatcatgacaggctgggtaataaatattcgtgaagaaagaagaaattaaaaaaagaaacgaagaagcaaaaaaaagaaaagactccgtttaatcactttcaaccgcggtttatccggccccacccatgcataaccctaaattattagatcacttagcacgtgaaaaagaaacgtttttaatgttttttttttttttttctttttctttttttgcgttggtgaaaattttttcgcttcctcgagtataattatctcatctcatctttcatataagataagaagttttataaaaaccttttgcatcaaaattttgtagaatatctctttttcttacgctctctttctttccttaattgttttctaaagaaccgtgtatttttctagttcgaatccatcgataacattaaaag

SEQ ID NO: 1588 - DNA, 600 bp, Saccharomyces cerevisiae
gggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 1589 - DNA, 712 bp, Saccharomyces arboricola
ttatttttatttttgtttgatttatccctttcgctatattcaaattatagtagaaagtgttgtcaccacattgcaattcaagctatcctatatttaaacaatttctattcttacttatatgccatgaaggatttcaataacccccagtatcactaccaataaaggaaagcaatatttaatagcttttactactatatggttagctgctcactactactttgcaatgttgaagtacggattacttaccgccgaccggatgacagcactccggcggaatactcttttccgtgcgtcaccgtctgcgccggtcgtgtccctgaactcagatgtgtctcgcaccgccatgctccggacaatgcaaaagtaggaagaggtgcctgtcgtgatggttatagtgaatgcaaaagacgattcccctggccccgcatactttgcactcggtacaatgcattgattagcataatgataataatacgattgagggggtttcctcaccattgtaatagttgcaacataaagtggtggttttcaatatcttgacaaacatataaatgcaaatgtaatattgattaaggtactcagttttttaatcattccctctttatagttttatcacttctagttccacactactatgagctaagaaagagatcaagagcaaatttttaatatctttcggaatactatttatttagggaaatatacaactaca

SEQ ID NO: 1590 - DNA, 710 bp, Saccharomyces bayanus
ccacaaccgcaccagatccggaagacacagagaacaggagattaccagatccagatcagcagaacaccggaacaaaggccggaaggactccaagcagccgcacacctgatttgtagccagtgagttcgcacctaactccaataaagtgcagaataaatcctgcattaacacactgagagtcgggccttggacggccgattatagtccttttgtcgccataaaaagtcccctcgaggtcacgtgcgcgaaggaaccccccctgagcagcttttcgcccagaaatcaaggaaggggcggcaccagcaggcaccggcggccactagtccgtgcggcggggtctgtgacattcaggggccagcgtgcctttagtgatatcgccgcagcgcgcaaactcggagaggaccactccgagcagaagttagttaagcaattctctacgctaaaaaaaaaagtaaagtggattaagctcctactggagagttaagtatgtgtacacttccagatatgcacaacgtgctaggcaactattgttctaaggagagatgtggtgcggagtaaaatgcggaggtagtatggggcttgcagacatatataaagtctagtcattcggctgaaaataaactagaaactacttcttccctttccatctacatcccactcatccaacaatatcaacaatacaatagtaatataatatacacacattcaaa

SEQ ID NO: 1591 - DNA, 668 bp, Saccharomyces cerevisiae; identical to SEQ ID NO: 1580

SEQ ID NO: 1592 - DNA, 700 bp, Saccharomyces cerevisiae
ctaatccaaggaggtttacggaccaggggaactttccagattcagatcacagcaatataggactagaaaatatcaggtagccgcactcaacttgtaactggcaactactttgcatcaaactccaattaaatgcggtagaatcttttcacaaaaggtactcaacgtcaattcggaaagcttccttccggaatggcttaagtaggttgcaatttctttttctattagtagctaaaaatgggtcacgtgatctatattcgaaaggggcggttgcctcaggaaggcaccggcggtctttcgtccgtgcggagatatctgcgccgttcaggggtccatgtgccttggacgatattaaggcagaaggcagtatcggggcggatcactccgaaccgagattagttaagcccttcccatctcaagatggggagcaaatggcattatactcctgctagaaagttaactgtgcacatattcttaaattatacaacattctggagagctattgttcaaaaaacaaacatttcgcaggctaaaatgtggagataggataagttttgtagacatatataaacaatcagtaattggattgaaaatttggtgttgtgaattgctcttcattatgcaccttattcaattatcatcaagaatagtaatagttaagtaaacacaagattaacataataaaaaaaataattctttcata

SEQ ID NO: 1593 - DNA, 694 bp, Saccharomyces cerevisiae
aaaaggtctaacatcctttgagttatgttttcgtcaccacagttaaagagaaaaaaaaataaatagcgggtaaataattgtcatactactgatttgcattgttaccttgtaactttgaacactagccatgcaggttgcttttcctcctttacaccttcccccctgtcgctgttcaaaagtaaatgcaacaacaataaaacgtgggtagaggacgttccctgtatgtactaaaatcatactatcatccgttgaggtcgagcggttctctaatctcaacacacgctgctgcccctgagcttgcgagctaaggacaacagggccaacttgttctttctaggggggagaggcccaacttaggctcggtgaagagaagcgcggagctcacgaaaaggggtggtgtcgcgcactacttttttcgtggggaacttacgtgaaaggggacgttatacttttgttatgtgcagttccaggaacaaacaggggttgaaaagtgtaaaagaaatagttgattctttcagaatctggatgactgccgcccgaacaatgtgggaaatataaaaaggtaccgttaatattgtttcattttcgaagatagtgttccatgtctttcttcagcgttgcttgaacaataggataataagaagaagatcaaccaatctttctcagtaaaaaaagtaacaaaagttaacataac

SEQ ID NO: 1594 - DNA, 700 bp, Saccharomyces eubayanus
ccacagagaacaggagattacaagatccagatcaccaaaatgccggaacacaggctgaaaaactccaagcagccgcacacccgatttttagccagcagattcatacctaactccaatgaattgcagcatatatcctgcaataacacattaaggatcgggccttggacggccgaatatatgattatagtccttttgtcgccaaaaagtcgcctcgaggtcacgtgcatccgaaatcaccccctgagcacttcccgcccagaaaacagggaaggggcggcaccagcaggcaccggcattcactcgtccgtgcggcgtggtctgtgccgttcaggggcctgcgtgcctgtgatgatatcgctgcagggcaccgagtcggagaggaccactccgagccgaggttagttaagccattctctacgctaaaaaataaataatgtggattaagctcctactggaaggttaagtgtttgtacactttcaaacatgcgcaacgcaccaggcaactattgttctgaggagggatgtgatgcggagtaaaatgtggaggaattacggggcttgcagacatatataaactctagccattcggctgaatataagctagaaaccacttcttctctttccatctacatctccctcatctatcaataagaactataatatcaacaatactataatataatatatacacacatttaca

SEQ ID NO: 1595 - DNA, 673 bp, Saccharomyces kudriavzevii
atgttttatttgtagagttcaatttttctctcttacttcaaaaatgtagtgagctgtatcgtcacacttttacggagcgctattatcataagcacggatatttctagtcttacttatatgttagagaaattaccaataccccttagtaccttaaccaaaagagaaaggacctttcaataaggctaaaactcaacgcttagctaccaatttctttgcaatgttgaagaacggatcagaaactgccgagcggacgacagctctccgacgggatgctctactccgcgcgccattgtcttcattagttgtgtccctgaaaacaaacatatctcgcaccgccatgctccgaacaataaagagtgaaagagttgagggcaaactcccctggtttcacgtcccgtgtaaccaatggaacaagttcattcgcatacgatggtatcgaaattagctttgacatgcttctatgatggttctgtacaagtgggtactttccttccagcaaagatataaatgctaaagtaaaattgatatagttgcactgatttttcattccgttcacttttttagttgcatagtttctgattttaggttgctttaagataaagaaaatagcaaacaacaaatatttgatatctgtttatacattactcataaaagataaaaataaaaatctata

SEQ ID NO: 1596 - DNA, 700 bp, Saccharomyces kudriavzevii
taaaccaattttatttgaacttgccccgctaatcgtacagacgtaccagatccaggtcataacggtgccattagaaggccgtagaatagacccactaaagctatcacaggcaaccttgcatccaagtctaattaaacggagcagaatctgttccagtaatgtataaagaattaactaccggaaaagcgtcttccggggcggctcaaccggattacattcttttttcttttttgcggccagcattcgagtcacgtgctcaaatactgaggaaggggttcttccggtaggcaccggcgctcactcttccgtgcggcacactccccgcagttcaggggccatgtgcctgtgagagtatttccgcaggccatagttccggggtggaccactccgagctaatgctaaagtaagcccttcccaacttgaaataggaacaaaagtcaattatgctcctcctgtaaagctaaacgtgtaaagattttagagtgagacgttgttagcagtcgttgttcaagggagggatgagttgaggaataaaatgcggaaaaagtgtgggttagacagacatatataaactctagccattcggctgaaatatatctgagttcatttgtgagaacttttttgattacttgttcatatatccacaagaacaacgactattaaacaatagaaaatagtataataaaaaaagttttttaca

SEQ ID NO: 1597 - DNA, 709 bp, Saccharomyces mikatae
atatgtttatttttttgatttctttagttttcttcccttaacttcgaaatgataaaagagaaaatagccacatcattgcaatccgctactatcctacttttagatatttgtgatcattcttatatatcactgagagatgctaataactgtgttacctctaacaaaagaaggggacttccagtaaggctttccttatttgtctaattgcccattatttcgtaatgttgaaatacggatcagaagctgccgaccggatgacagtgctccgacggaagactgctctccgtgcggtgttgtctgtgcggatcacgttcctgattacggaagcgtttcgccccgccataccccgaacaatgcaaatgcaaggacgcatgcctgtagtggcggttatggtgaacgtgaaataacagttccttgacccctcacatactttgttccgtgtacaacactctggttagaacaatggtgggtttgcggtcaacgttctactcgtcttttactttacttctgtagcagctcaagcaatggttttcagttccttttgcaaacatataaatataaaagtaatgccgcctcaatcgcatagttttcctttattccatttgcacttcttagatttgttgtttgtttgatttgttacataaatatcaaaacatcaataacaattatccaacatctctttatccaaggaaaaaaataacaacatata

SEQ ID NO: 1598 - DNA, 700 bp, Saccharomyces mikatae
ttacggatcagaggagttctccagatctgaatcacgatgatttcggaaaacacagggcaaagagaaacaaggtagccgcactcaattcatcttttagtgactacttttcatcgaaatccaattaaatgcagtagaatctgttcaaaaaaatgtacatagtgtcaattcggcaagctttcttccggaatggcttaaccagaccatatatctcttcattattttcattttaaggtccggagtattgatcacgtgatcaaattcccattgaagggttgccttttaaaggcaccggtagtcactcatccgtgcggagtgttctgcgccattcaggggccaatgtgcctttgagaagattagagcagggagcagactcggggcggaccactccgagccgatgttagttaagccttcccatcttgaaataggaacaaaatggctttatactcctgccagaaagcaaggcatgtgtataccttctcaagaatatacaacgttttggcagctattgttcagaagagggatagatcgtaagctaaaatttggagaaattaaagatttgtagacatatataaactatcagcaattcactgctaaaatacatcttgagagtaactcttcgcttattcatcttgttcacttttcgatgaagaaaaccactgttaagtaaaataaagaataacatataaaaaactttttcata

SEQ ID NO: 1599 - DNA, 673 bp, Saccharomyces paradoxus
ctatgttgatcttttcagaatttttcactatattaagatgggtgcaaagaagtgtgattattatattacatcgctttcctatcatacacatatccatatctagtcttacttatatgttgtgagagtgttgataaccccagtatcttaacccaagaaagcctttctatgaaacttgaactgtacgctaaactgctcattgcaatattgaagtacggatcagaagccgccgagcggacgacagccctccgacggaatattcccctccgtgcgtcgccgtcttcgtcggttgtgtcccttaacatcgatgtacctcgcgccgccctgctccgaacaataaggattctacaagaaatacttgtttttttatggttatgacaggaacaaaataagcagcccactgaccccatatacctttcaaactattgaatcaaattggccagcatatggtaatagtacagttagggttttccttattcctgagacaattcatccgcaaaaaataatggtttttggtctattagcaaacatataaatgcaaaagttgcatagccactttaaatacatttgctcctccaagatttttaatttcgttttgttttattgtcatggaaatattaacaacaagtagttaatatacatctatactttatcgtcaaggaaagaacaaactata

SEQ ID NO: 1600 - DNA, 700 bp, Saccharomyces paradoxus
atttaaggaggttttacggaccagaggagctttccagatccagatcaccggaatatagggcaagagaacatcaagcagcagccgcactcgagttatcactggcaactactttgcatcaaactccaattatatgcagcagaatcttttcttttaaaacgcacttagcgtcaactcggagggcttccttccgggatgacttaaccagattgcaatttcttttccattttacagttaaaaataggtcacgtgatctaaaatcgagaaagggttgcctcatgaaggcaccggccgtcactcatccgtgcggagaggtctgcgccattcaggggtccatgtgccttagagagtattgatgcagagggcatcgtcggggcggaccactccgaaccgacattggttaagcccttcccatctcaagataggaacaaaattgcattatactcctactagaaagctaaatgtgtacatgttctcatgaatatacaacgttctaggtagctattgttgagaggagggatactcagtaggctaaaatgtggggaaaggatgagctttgtagacatatataaacaattaacaattggactaaaagtttggtgttgagaatcgctcttcgctatacatcttgttcacttatcattgagattaaccaacattaagtaaaataaagattaacataatataaaataattttttcata

SEQ ID NO: 1601 - DNA, 700 bp, Saccharomyces pastorianus
accccaccagatccggaagaccacagagacagacgattacaagatccggttcacaagaacaccggaccacaggctagaagggactccaatgtgccgcacatctgatatgcagtaattaagctcgcacctagctccaataagttgcagcatgaatattgcaataacacaccgagagtgttgggtcttgaacggccgattgtagtccgtttgtcgccataaaagtctccttgaggtcacgtgcacctaggattaccccttgagcaactttccgcccagaaatcaaggaagagaggcactggaaggcaccggctgccaccagtccgtgcagtgggtctgtgacattcagggaccagggtgcctttgaaaaaatcggtgcagggcacaaatcggagaggaccactccgagcagaggttagttaagccattttctacgctaaaaaaaaaataaggtggattaagctcctagcggaaagttaagagtgtgtacgcttccagatatgcacaacgtgcgaggcaactattgttccaaagagggatgtgttgcggagtataatgcggaggtcatatggggcttgcagacatatataagctctggccattcggctgaaaataaactaggatctatcatcgtctttccatctatttctcactcatccaacaatatcaacagtacaaataatattatatatacacattcaaa

SEQ ID NO: 1602 - DNA, 700 bp, Saccharomyces uvarum
aaaagaaggggctttccaaaaaccttaatttgttggcgcaaccaaagtgttttccagctggctaatggttcatatgctcaagtgtcctcaaaacgtttacaagctaaaaaggacaagccccccacgcaagcgtgggaactgccgactgaggccaatgccctgtattagttcatgcaaagatatcaacaccatcctttttcttacctttgtaaattaatctcacatacagaagaagtcatgctcctacgggtgttttgtggccgcagcccttgccacgcgggcgaagatcttccgagcggacgtctctcgaccgaagtggccccttagtgggcaaacgtcctagatgttccggtacgccgatactgttcctgaaaaatgtggagtttctccggaaaagagacatgttctttcgggagacagtgctgcggtgacatgaaatagtatcacataagctcaggatgcctatgcaagtggggatttttattgaagcattgtatgtgggagggatgtgtctggcgtaaccttgttttgatataaaacgaacggctgcatgctgcagtcttgagcttttcttgcttattcaattcttgttctacttggtaaatagccgtcaagaaaaatacaaggtaatctctccccttagttattgcattattctaaataaatcaaagagaagatttttttgaagaatagataaaaa

SEQ ID NO: 1603 - DNA, 600 bp, Saccharomyces cerevisiae
aacatatatacacaattacagtaacaataacaagaggacagatactaccaaaatgtgtggggaagcgggtaagctgccacagcaattaatgcacaacatttaacctacattcttccttatcggatcctcaaaacccttaaaaacatatgcctcaccctaacatattttccaattaaccctcaatatttctctgtcacccggcctctattttccattttcttctttacccgccacgcgtttttttctttcaaatttttttcttctttcttctttttcttccacgtcctcttgcataaataaataaaccgttttgaaaccaaactcgcctctctctctcctttttgaaatatttttgggtttgtttgatcctttccttcccaatctctcttgtttaatatatattcatttatatcacgctctctttttatcttcctttttttcctctctcttgtattcttccttcccctttctactcaaaccaagaagaaaaagaaaaggtcaatctttgttaaagaataggatcttctactacatcagcttttagatttttcacgcttactgcttttttcttcccaagatcgaaaatttactgaattaaca

SEQ ID NO: 1604 - DNA, 600 bp, Saccharomyces cerevisiae
ttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaa

SEQ ID NO: 1605 - DNA, 806 bp, Saccharomyces cerevisiae
tttcttgcgtttcttcactgtgatgcttgtgagaatattaggatataccaacgtgcaactctgaaatgtcaaaacggtcgtgtataaataaatgatataccagtaggtgaaatcatctcatttgtctttctaaaaaagtccattacccttaaggttgttgtcacaacccacggagcagttttagaggtgcaaaattgaaagaatggccacattttgagcaattcatcgacaacaagagcttatgattaacttgggttgtgggcaattgggtgtactatgaagcagccaatacctgttttacaacagtattctcagtttcagcttagagatgtgtcaaatcgaaggctagtgtggtgcacggagtttatggcacattggtaagtaatcattgcaacttttttttatttgaggaatatagtaagagagaagctttagtgatggtcaaagaagagaggaatacaagtgagttgtatctaggattttttattacgtgagtgttgttttactttagtcggtaggaatcattgttatttttgtctgtttgtttgtctctatttttgggtacacgtgcgtgtttcttctagtggatggtttgaacgaagcaggttctcaggattgattgattgatctgctttagtgtgtaacgttctgcgactagctttcgttgctaccgatatataaagaaaaaaaggagagcgtgtgtttggagcgtcttaaaccccattggtgagagcctccagtaccatttgcctgttaaaactgtcttgtgtgtggccttgtagagaaggtgaagagggagagtttat

SEQ ID NO: 1606 - DNA, 289 bp, Saccharomyces cerevisiae
ggatagcaggtacatataaattgttacatactaagtcgatgagtcaaaaaagactcttatacatttatacattttgcattattattttttttttccagcggaatttggaattccgctctcaaccgccaaaattcccctgcgatttcagcgacaaagagtcataaagtcatcctcgagaaaccacgatgaaatatataaaaagcccatcttccctgacggaaactggtattttaggaggcataccataagataacaacgaaaacgctttatttttcacacaaccgcaaaa

SEQ ID NO: 1607 - DNA, 1390 bp, Saccharomyces cerevisiae
tcaaccacaagccttttaaaaagaaaaattgaaaaaataataaaaaaatttgaaaaagaaaaaaaaaatcataaaaccaatcttaagaaaaaccaaaaaaaaaccgctaattaaaatctaaaaaattgaaacaagaaactgtatgattagtaactaatatactggcgcggaagggaatgaatgccatttaaatgagatgattatgaaaatatagcgtagagtagatgcgcgaaaccgaggcagaaaagaaaaagagacaagttaaaaattgaatataatgatatatgggcactttcttctgtgctaggaaacggaggtagaaggggatagcaagcttgagcagtaattaaaaaaaaaaaaaagcatattgatagatagctcatttgtagttaactgacgacatttatgtacataattaaaatagaagaaaattttcaaaaaaaattctcctggcgattgttagggacaagaaaacaagccatgttgtaaccaataaatgttacacgccttcaaaataaaaaaaagatggacaaaagagataaatcttttgctttttcttactctgtgttgttgtcaacaaagacaacaaacgtgtgaataatctacgggattcgtttaccataggctacctagaaatggcatagtcatggagataaagtcccatgatattgtaaactaaattgaaagtaaaatcaaggaaaaaacaagtgagattgcaataagcaatcaagagagaaaagttttttgactgattttcgacttgcttttataccgattttgaaaagtcgcggggaaaagctggcaattatttttcattttttttcattagggctagaagttgctaagagcaaacaaactgttacttgaaaggttttcccacgttggtagctacatatgcaagagtcttatgtatcgtatctaagtgccacgtaggggattcccatcatttgatgatttccaaatataatacctgtagagagcggtggagcaaaagtcaaattttaatcgcaactgcagacaagtcaagctgaggaaattgtggatgatctcttgtttcttttgatattcaccacaacagaagtgaagagtgtgattgcggttactactgaccacgaagcaatgcgtttagtagtgaaaagaattactcatactctggaatcgaaattccgttggaaaaattcgctttgtagtgaaaaataaagatgtcaataaagggtattgagaatttccaatggaattatcagcaatagatgatagaaagtagcacagaatttggcttaatggtatataaaccgtagggtcctggtaaaattacatgggaaggatccttaggcagtagggaaaacttatcaggacaattgagttatattaacgtattatatattttaat

SEQ ID NO: 1608 - DNA, 1557 bp, Saccharomyces cerevisiae
tttgttttgtttgtttgtgtgatgaatttaatttgaaactaagttcttggtttttttaacatttaaacaaacaataataaaatgaatagacacacaagaaaaaaactatcttgaatgagtgcaacctttatatattcttccaaacctacaaaaaaattgcaggtctgcgatcactgggtactatcaaaacacatattagcatacgtatgtgttcgtacgtgcggtccgcaaggtctttgtgacagccatgacatgattggattgaatagttcacttcagctgtcaccaccagttttaggccctaacacatcagtcgagttccactaggctttgttagccgtagctgcgttgcaacaactgcgcaaaacgcgcgacttcctgtaaatgccgcagatcacgtggtaaagaaaagaaacaacaggccgacccagtttcgttgtttcttttcattatttctggatgctcttcacaacgtatttcatgacatacttattgaattagtggaagcccaaaacatcattaccctggaaaacttaattgacgtaaattaacttcagttgtcttatgttttttgcatccttaactttagccgcgcagggataatcatatatgtcgaaagagcaactaaacaatacttaaaaacgtgtttgaacttttacgaaagggtaacgacaaataatcattcactggaaaaaccaataaaccataagtaaatgaaaaactgtttcaaccgatgttggtactttccatgtcttaaaagagtacaatttataaattaatgaaaacacagaagtatttagatcggctcaaatgtttttggacattaaaagatcttgaaactgagtaagatgctcagaatacccgtcaagataagagtataatgtagagtaatataccaagtattcagcatattctcctcttcttttgtataaatcacggaagggatgatttataagaaaaatgaatactattacacttcatttaccaccctctgatctagattttccaacgatatgtacgtagtggtataaggtgagggggtccacagatataacatcgtttaatttagtactaacagagacttttgtcacaactacatataagtgtacaaatatagtacagatatgacacacttgtagcgccaacgcgcatcctacggattgctgacagaaaaaaaggtcacgtgaccagaaaagtcacgtgtaattttgtaactcaccgcattctagcggtccctgtcgtgcacactgcactcaacaccataaaccttagcaacctccaaaggaaatcaccgtataacaaagccacagttttacaacttagtctcttatgaagttacttaccaatgagaaatagaggctctttctcgagaaatatgaatatggatatatatatatatatatatatatatatatatatatatgtaaacttggttcttttttagcttgtgatctctagcttgggtctctctctgtcgtaacagttgtgatatcgtttcttaacaattgaaaaggaactaagaaagtataataataacaagaataaagtataattaac

SEQ ID NO: 1609 - DNA, 982 bp, Saccharomyces cerevisiae
taaaggagaataaatcgttttctactttcttctgctgctataataagcacctatgggatctatatagtatttttataacgatagactttataaaagaaaatacctaagtgaaaatttggtgaattttgagataattgttgggattccatttttaataaggcaataatattaggtatgtagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgtatttaaagatatttaatgctataatagacatttaaatccaattcttccaacatacaatgggagtttggccgagtggtttaaggcgtcagatttaggtggatttaacctctaaaatctctgatatcttcggatgcaagggttcgaatcccttagctctcattattttttgctttttctcttgaggtcacatgatcgcaaaatggcaaatggcacgtgaagctgtcgatattggggaactgtggtggttggcaaatgactaattaagttagtcaaggcgccatcctcatgaaaactgtgtaacataataaccgaagtgtcgaaaaggtggcaccttgtccaattgaacacgctcgatgaaaaaaataagatatatataaggttaagtaaagcgtctgttagaaaggaagtttttcctttttcttgctctcttgtcttttcatctactatttccttcgtgtaatacagggtcgtcagatacatagatacaattctattacccccatccataca

SEQ ID NO: 1610 - DNA, 1084 bp, Saccharomyces cerevisiae
cttaaaagaaatatttattgtttccgaatttttaatgtcagagatcaagtcagagcggctgcctttaccgtaattttcaattgctaaatacaatgttccttggttatcccatcgccaataatttttatttttaccactgttgaagaagcgaaagaaaaaaaaagggaaaatcaaaacattccctgtgcactaatagaagaaaacaagagactccgtccctctttagtgagaaaattgaccagagatggtttttgtccatcttttcgcaaaaaattagttctattttttacacatcggactgataagttactactgcacattggcattagctaggagggcatccaagtaataattgcgagaaacgtgacccaactttgttgtaggtccgctccttctaataatcgcttgtatctctacatatgttctatttactgaccgaaagtagctcgctacaataataatgttgacctgatgtcagtccccacgctaatagcggcgtgtcgcacgctctctttacaggacgccggagaccggcattacaaggatccgaaagttgtattcaacaagaatgcgcaaatatgtcaacgtatttggaagtcatcttatgtgcgctgctttaatgttttctcatgtaagcggacgtcgtctataaacttcaaacgaaggtaaaaggttcatagcgctttttctttgtctgcacaaagaaatatatattaaattagcacgttttcgcatagaacgcaactgcacaatgccaaaaaaagtaaaagtgattaaaagagttaattgaataggcaatctctaaatgaatcgatacaaccttggcactcacacgtgggactagcacagactaaatttatgattctggtccctgttttcgaagagatcgcacatgccaaattatcaaattggtcaccttacttggcaaggcatatacccatttgggataagggtaaacatctttgaattgtcgaaatgaaacgtatataagcgctgatgttttgctaagtcgaggttagtatggcttcatctctcatgagaataagaacaacaacaaatagagcaagcaaattcgagattacca

SEQ ID NO: 1611 - DNA, 654 bp, Saccharomyces cerevisiae
tggttagaactttcgtgataatttatttttatagttgaatatcttctttctctctcaactctgatccggattgtcgaggtttcaataagttactctgaacaactaatcaaaatatctccttatttctgtagattccttcagttccactttttgcttttcttaattctctttgtatttattcctagcgacgaaaaatgcgagatctcgaccaaaaaaagggggtagggtaataaaattaaccctattatttttgaactttaaaacctataatgtgctaatattttattatacacctcctttttttgtgtttaaaccctgacacattttaagccctatatttacggtattagttgattaaactccgaagcgaaaggaattcggtcattagcggctaatagccgttggggtaaatcacctacaagcaagtacacaagagaacgttggcgttgttaagtcaaagcactaatacattggggctttaagagtgttttataaaggtctgacctgtaaaaattatttaaacaacttgaacaggccttaaagttttcctcattccgctcatcatcactaatattgctctccgtttttgaatacacacttgacactaataagtatcacagaaaaaaagaaaatataataaattagtattgcgat

SEQ ID NO: 1612 - DNA, 659 bp, Artificial Sequence
  source: /note="Description of Artificial Sequence: Synthetic polynucleotide"
tttcaaaaattcttactttttttttggatggacgcaaagaagtttaataatcatattacatggcattaccaccatatacatatccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggtgacagccctccgaaggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttattttaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaac

SEQ ID NO: 1613 - DNA, 262 bp, Artificial Sequence
  source: /note="Description of Artificial Sequence: Synthetic polynucleotide"
gacagcattcgcccagtattttttttattctacaaaccttctataatttcaaagtatttacataattctgtatcagtttaatcaccataatatcgttttctttgtttagtgcaattaatttttcctattgttacttcgggcctttttctgttttatgagctattttttccgtcatccttattttcagcttcatctccagattgtgtctacgtaatgcacgccatcattttaagagaggacagagaagcaagcctcctgaaag

SEQ ID NO: 1614 - DNA, 785 bp, Saccharomyces cerevisiae
attatactatttttttagttgtttgatgttcttctatgtagcatcagaaagaaacaccaacccgaaaattcttcaaacaatcaataccaaaccgctttatataaaaaattaagatgtcgacattccttattttttactgagttcgttaaagttgggtacactcttgattactgtaattgtctctgtatgtccctcaagcccggtacgttgtcattttctagtacgcatcaacggagtgttacatgatagatagaccgagtagaatctatggctatggggtaattaaaaccttaaagctcctttcgctgccatagtaatacgaatagaccttggctatagtaagttgcatctgtaccgtagagattcttgcaactcgcttaaactctcgcttttagataatatttctccttattgcgcgcttcgttgaaaatttcgctaaacacggggtttaagttaaagtttacaggatttatccggaaattttcgcggaccccacacaattaagaattggctcgaagagtgataacgcatacttttcttttctttttttagttcctagcgtacctaacgtaggtaacatgatttggatcgtgggatgatacaaacaacgtaagatgaatagttccttcctcaattcttcttgcagcatcattttcttgaggcgctctgggcaaggtataaaaagttccattaatacgtctctaaaaaattaaatcatccatctcttaagcagtttttttgataatctcaaatgtacatcagtcaagcgtaactaaattacataa

SEQ ID NO: 1615 - DNA, 700 bp, Saccharomyces cerevisiae
aaggcaagcccagaaaaatatcgcaagcacctttggtcttacagtgccaacttttggcctgccgacgttaagagtacaaagctgatggcaatgtacgacaagataacagagtctcaaaagaagtgaaacaatttttcttcaccacattttccattgttccttccccccataactataaacgtatttatgtatatatatttgcgtgtaagtgtgtgtactatagggcaccgtaaagtaataatgcttaattagttactactatgaccatataagaggtcatactgtatgaagccacaaagcagatagatcaatcatgtttaacgaaaactgttaatcgaagattatttctttttttttttctctttcctttttacaaagaaaattttttttgcgctttttgccatcaccatcgcaagttctgggacaattgttctctttcgctccagttccaaggaaagaggtttctgttttacttaatagaaagtgtcatcttgtattttatatctcttctttcttgtgtaaaattctttagttttgattttgtatttttaggacagtgagctacgaagtaacatttttacttaataaccgtttgaagcatagagcaggccctggtaccaccacctaatatctggctttttattcaataaaaactcaaaaaaaaaaatccaaaaaaaactaaaaaaccaataaaaataaa

SEQ ID NO: 1616 - DNA, 700 bp, Saccharomyces cerevisiae
gtgttgttatccgatacaaccggatatttttcttttaatgagtctaaaccgtgatagcttcaggttaatacaatcaaaaaaagctcaaatattcttttaatgccgcgttcacagattccaattgaatacaactaggtagttcattatatgaagcctttgctactatttttcactatagtctgccttcaccttaatgcagacatccacatattttaatcactttaaaataaaaaggaagatatattagaagctatgatccaatctgtaagccagattaaaattcacgaactcttctttcatttgaattgaatgctttgagttggggtagattatcgcaaattactcatcacatttattgactacgaacttgctgatgtcctttttttatttatatttttcttcagtgaagcgattttttttttacacagaccaagacggaaaaaagtagctaaggaagaaaacaaaatcatgaaaaaaatgtgaagtgatcatgcacatcgcatcaacttaaacattggcttagagatatatagagttagagtttacggcaacctttaagcaccaataccttttggcatagtctaaagacctggttcttaattttaaacaaatttaactaaagatttccctatcaaagaagtaacgagttgacagattttctcaaaataaatcgatactgcatttctaggcatatccagcg

SEQ ID NO: 1617 - DNA, 700 bp, Saccharomyces cerevisiae
tcttggggccttaccaccagtggactttcttgctgtttgctttgttctggccattgtttgcgtttatatatttatgttagatgtttttcttattaactagaaagaaagaatataaaaggttgaggaaagagatgtatcccgaagaatacacagtcttttatatatgtatttcaacaaggagccgtggagggtactaaaaagaaaaatcgcccgggcatttcgttatcttccacgctaaaagtcaaggagagatattacggccaggatcgcaaaggtgcagagcaaggaaatgtgagaaattgtgagaacgataatgtatgggacaatgcgaaaatgtgagaacgagagcaaaaatcttttttgtatctccccgccgaatttggaaaccgcgttctgaaaacttcgcatcttcacatagtaaaactgttccgagcgcttctccccataatggttagtggtaaaaaccgaagttgtttactttagcaaatgcccgcgaatacggtggtaaattgccacccccccttccccattcattgggtaaagaccaatttgatggataaattggttgtggaaaaggtctaattctttttcctataaataccgagatattttttctatatgatggtttccgtcgcattattgtactctatagtactaaagcaacaaacaaaaacaagcaacaaatataatatagtaaaat

SEQ ID NO: 1618 - DNA, 586 bp, Saccharomyces cerevisiae
cgtggaaatgaggggtatgcaggaatttgtgcggggtaggaaatcttttttttttttaggaggaacaactggtggaagaatgcccacacttctcagaaatgcatgcagtggcagcacgctaattcgaaaaaattctccagaaaggcaacgcaaaattttttttccagggaataaactttttatgacccactacttctcgtaggaacaatttcgggcccctgcgtgttcttctgaggttcatcttttacatttgcttctgctggataattttcagaggcaacaaggaaaaattagatggcaaaaagtcgtctttcaaggaaaaatccccaccatctttcgagatcccctgtaacttattggcaactgaaagaatgaaaaggaggaaaatacaaaatatactagaactgaaaaaaaaaaagtataaatagagacgatatatgccaatacttcacaatgttcgaatctattcttcatttgcagctattgtaaaataataaaacatcaagaacaaacaagctcaacttgtcttttctaagaacaaagaataaacacaaaaacaaaaagtttttttaattttaatcaaaaa

SEQ ID NO: 1619 - DNA, 346 bp, Saccharomyces cerevisiae
gcaggcgggaaaccatccacttcacgagactgatctcctctgccggaacaccgggcatctccaacttataagttggagaaataagagaatttcagattgagagaatgaaaaaaaaaaaaaaaaaaggcagaggagagcataaaaatggggttcactttttggtaaagctatagcatgcctatcacatataaatagagtgccagtagcgacttttttcacactcgaaatactcttactactgctctcttgttgtttttatcacttcttgtttcttcttggtaaatagaatatcaagctacaaaaagcatacaatcaactatcaactattaactatatcgtaatacac

SEQ ID NO: 1620 - DNA, 695 bp, Saccharomyces cerevisiae
caactttcccttctgtttcaatctttttacctattcctttttaaaagatatatatacattaaactccttctacaagtatatattttatacatatctacagggcgtatatatacataacattttaagataagcaagtgaatgttgattcccgtttcttagtcaacacttctttctattttacccggtcgttaccctattaaaaaaacaacttacaatcattgttcgccccttccatacttactgccactcgcaaaagggcccaaccagggcaattacgtatcaaaaaatcatgacaggctgggtaataaatattcgtgaagaaagaagaaattaaaaaaagaaacgaagaagcaaaaaaaagaaaagactccgtttaatcactttcaaccgcggtttatccggccccacccatgcataaccctaaattattagatcacttagcacgtgaaaaagaaacgtttttaatgttttttttttttttttctttttctttttttgcgttggtgaaaattttttcgcttcctcgagtataattatctcatctcatctttcatataagataagaagttttataaaaaccttttgcatcaaaattttgtagaatatctctttttcttacgctctctttctttccttaattgttttctaaagaaccgtgtatttttctagttcgaatccatcgataacattaaaag

SEQ ID NO: 1621 - DNA, 679 bp, Saccharomyces cerevisiae
aactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 1622 - DNA, 783 bp, Saccharomyces cerevisiae
tagcgtcaacaacaagaagtttaatgacgcggaggccaaggcaaaaagattccttgattacgtaagggagttagaatcattttgaataaaaaacacgctttttcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacaaacaaa

SEQ ID NO: 1623 - DNA, 700 bp, Saccharomyces cerevisiae
cacccatgaaccacacggttagtccaaaaggggcagttcagattccagatgcgggaattagcttgctgccaccctcacctcactaacgctgcggtgtgcggatacttcatgctatttatagacgcgcgtgtcggaatcagcacgcgcaagaaccaaatgggaaaatcggaatgggtccagaactgctttgagtgctggctattggcgtctgatttccgttttgggaatcctttgccgcgcgcccctctcaaaactccgcacaagtcccagaaagcgggaaagaaataaaacgccaccaaaaaaaaaaaaataaaagccaatcctcgaagcgtgggtggtaggccctggattatcccgtacaagtatttctcaggagtaaaaaaaccgtttgttttggaatttcccatttcgcggccacctacgccgctatctttgcaacaactatctgcgataactcagcaaattttgcatattcgtgttgcagtattgcgataatgggagtcttacttccaacataacggcagaaagaaatgtgagaaaattttgcatcctttgcctccgttcaagtatataaagtcggcatgcttgataatctttctttccatcctacattgttctaattattcttattctcctttattctttcctaacataccaagaaattaatcttctgtcattcgcttaaacactatatcaataa

SEQ ID NO: 1624 - DNA, 501 bp, Saccharomyces cerevisiae
gaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaa

SEQ ID NO: 1625 - DNA, 700 bp, Saccharomyces cerevisiae
ggatatcgtaaacaaaggcgttaccatagaaatgtactgattggcagaattactcttcaggagaatctttcatacaaaggtattccattggggaaaatctcgttaccaagtcaatgctgaactttctatggcctttgtttactatcgttaattattttacgaccacttctgggtagaaatatttcgtagccctggaacgagcttgtttacgcgttttatcccattatatggcacccaaatcaaatttaaaaagaaaaaacgcgtaaacagtgtcgggtaagttcatcctctgttactttaattgcttctttttttgaaattctaagtaaacgcgtcattttgatcctcaggacacagaaatccttgcagaatcttattgggtgttgaatagaggacgcgtaaaaacgatatggaaatttttttcatatagtgtagaaagaataggttggcgtaggtagtttcgtgtttgatagaaacctccaacaaagtctgcaactcacgttttagaataacaagtttagagtttatcttgttgcctttgttaagtcagtaccattgaataaaaattatataaaggagctaatatttcattgttggaaaattactctaccataattgaagcatatctcatccttttcatccttttcaacgcaagagagacaccaacgaacaacactttatttgttgatatattaacatc

SEQ ID NO: 1626 - DNA, 700 bp, Saccharomyces cerevisiae
tttgagaatgaccttccacgagctaaattgaaagggaagaatttattagttgaactcaagaaagaagaggatgacgtgggaaatggcatagaatcccttactaaatcgaacactaaactgaactccatgctggcgaacgaaggtaagatacacaaagctagtttccagaaaagtgtaaaatttaaactacctgataatatagtgactgaagaaaccgtggaacttaaagaaataaaggacttgctactacaaatgttgagatgacagcgagagattgaatcaagattatccaatatcgaacttcaactcacggaaataccgaaacataagtaatcatatcccttctcacattttttacacaggaagtaagcaagttatgttatatttccgacactataattaattcttagcagttaaaggtgctttgtctatattacatttacatacagcttgagtgatcctgaccggatatagggtcctattttcttacgtgaacggcttttcttcttgttcccgatggccttcatgtgaaaaagcactcctcgggaggcggaaaaatatcaaaagtacggggcgaagtttataatgaagatttatcgatataaattttggttatttcaggagaacaagaaagctctttacactaaaattatcagagaagaagctgatatattagccctaaggagtacaccaaaacaca

SEQ ID NO: 1627 - DNA, 514 bp, Saccharomyces cerevisiae
gtttacgcgacaactatgcgaaatccggagcaacgggcaaccgtttggggaaagaccacacccacgcgcgatcgccatggcaacgaggtcgcacacgccccacacccagacctccctgcgagcgggcatgggtacaatgtccccgttgccacagagaccacttcgtagcacagcgcagagcgtagcgtgttgttgctgctgacaaaagaaaatttttcttagcaaagcaaaggaggggaagcacgggcagatagcaccgtaccatacccttggaaactcgaaatgaacgaagcaggaaatgagagaatgagagttttgtaggtatatatagcggtagtgtttgcgcgttaccatcatcttctggatctatctattgttcttttcctcatcactttcccctttttcgctcttcttcttgtcttttatttctttcttttttttaattgttccctcgattggctatctaccaaagaatccaaacttaatacacgtatttatttgtccaattaccatg

SEQ ID NO: 1628 - DNA, 700 bp, Saccharomyces cerevisiae
ttcgtgctttgtgataaagtgtttcacgtcatccgacatgacttcgtagttatggactgaactgtgtggtgaggttccatgatttcttaggtccagcagatacatgtctcttcccaatttcttgttaaggttacggccaatgcttcggttgttgagcttgttaccgaataagccgtgaagtatgataataggtggtcttggcttcccttcatccccagtttttactgcatctctcttgattatgtcatatgaaaggtccagtgggacttgcttttgttgcagcacctttgctaatgaatgaaaggcacatagtgactgcttaaaaatgcaggaacttaaattattccgaatggtattttgtctcacatatattgtcccatactgtgccaagatcccggctttacccagtatcatcattgtaccgttaccaattctcctcgtatatcacggttagtttttaaacctcggggtgacgtttactattggcgtactaatatattcttattttcttttcttttttgttggcagtttcaagcaacacatgtactggataaccaacccccgcacgctcttggaaaaaattgagaaggcatcggacacttgctgatgagtatttcgaaaaattccatgaagatgaggccaagattgtttggaagagattgaaaagaagaagaagaaaaaaagataaaagcaaatcaaa

SEQ ID NO: 1629 - DNA, 694 bp, Saccharomyces cerevisiae
ccttgtgaaattgcaaatatggtgatttgaaacgtttcctagtgcagcaggatcacagataacgtgtaaagggcttagcagttgataatcctctctagttaagacctaaacaaaatgctgtcactaaccgtagtattaaatgacacactttggtgactttcgttaatggggatgtggtagtggccattgccaataaacaaaaagaacagggaaagaagtagaaagtgatataagtttgcttgccacttttcgtttttcacgaaaaaaacaggcgaaaaaaaatgctagacaagtacccggctgaatcacacctcgttaacagtgactttcggtgacagatacccgattgggcacccggctggtaagttatgatagaaagccaacgctgtactattggcttagctatggcaatattttgattatcagctagttttattaacgttataattagtgtaaccagtttttcatctatttcatttatttcatttatttactttaattgcagatccccctaacgcgtttaaagcttttattcactagcttatgtattttttataggaaacgcgacgcgtaacatcgcgcaaatgaaggttttgatgtattataatgaggtattcttccttatatacatcgatgaaaagcgttgacagcatacattggaaagaaataggaaacggacaccggaagaaaaaat

SEQ ID NO: 1630 - DNA, 700 bp, Saccharomyces cerevisiae
tgacccaacatcagatgacccaaggtccacctcttattaaaggacgtttgatccttcgacaccatggctctgttgaacttttatctgagagaggaaaaaaaggaaggaaaaaaaagaagaaacttcctttatttatttgtcttaaccacaacacacaatgcaataagatgcaatataatatcaaagccaatatcttatgttgctgatcctgagaaggaatatatacaatttatgtagtaaaataccttttcttctgcgagttgcaagaaatagaaaagactccgattgcgcatcgccagaataaaatttcacaaccacactttttggctgaactttttattacctgattaaacagagagagaaaaggtagaggtcaaaattttttaagcaaaactaaaaaagatgcaaaatcacgtgctgaaaatctaacataagggttaagattagagttttataggacttgttttgtaatatttcaaatacgagctaaccctactgatttcaattaggtctaatttagggttgagctgcactgaaatttcggaaattttgggttattttaaatgagacagaagaactacagagatacgttcttcagactttaaagcttatctccacaaagaattggtcaagaaatcatcctagaaaaacacgtttgctcactcgatcttaatcacatagagtgctggaacgggaagaa

SEQ ID NO: 1631 - DNA, 288 bp, Saccharomyces cerevisiae
agcgttggttggtggatcaagcccacgcgtaggcaatcctcgagcagatccgccaggcgtgtatatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggacctttgcagcataaattactatacttctatagacacacaaacacaaatacacacactaaattaata

SEQ ID NO: 1632 - DNA, 1000 bp, Saccharomyces cerevisiae
ttattgaaatcttacagaattttatagcaatcacatttgctattttccaacgttgtgaagtaatattatatgacgaattttacaaaaatctttcaaatgaggagattaatgttcaattgctattgattcatgacaagattttggaaattttaaaaaaaatagaaattatcgtatcctttttacgagatgaaatgaatagcaacggaagtttcaaatctattaaaggtttcaacaaggttttgaatctgattaaatatatgctgagatttagcaagaaaaaacaaaattttgcgagaaactctgataacaataatgttacagattatagtcagtcggcgaagaacaaaaatgttctcttgaaattccccgttagtgaactgaacagaatctatttaaaatttaaggagatttcagattttttaatggaaagagaagttgtccaaaggagtataattattgacaaggatttggaatctgataatctgggtattactacggcaaacttcaacgatttctatgatgcattttataattagtaagccgatcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcacataaa

SEQ ID NO: 1633 - DNA, 393 bp, Saccharomyces cerevisiae
tctagagtatggatgggggtaatagaattgtatctatgtatctgacgaccctgtattacacgaaggaaatagtagatgaaaagacaagagagcaagaaaaaggaaaaacttcctttctaacagacgctttacttaaccttatatatatcttatttttttcatcgagcgtgttcaattggacaaggtgccaccttttcgacacttcggttattatgttacacagttttcatgaggatggcgccttgactaacttaattagtcatttgccaaccaccacagttccccaatatcgacagcttcacgtgccatttgccattttgcgatcatgtgacctcaagagaaaaagcaaaaaataatgagagctaagggattcgaacccttgcatccggagct

SEQ ID NO: 1634 - DNA, 400 bp, Saccharomyces cerevisiae
gcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgttgtaatcgttcttccacacggatccacagcctagccttcagttgggctctatcttcatcgtcattcattgcatctactagccccttacctgag

SEQ ID NO: 1635 - DNA, 350 bp, Saccharomyces cerevisiae
acaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcaagcttcgcagtttacactctcatcgtcgctctcatcatcgcttccgttgttgttttccttagtagcgtctgctt

SEQ ID NO: 1636 - DNA, 225 bp, Saccharomyces cerevisiae
attgaattgaattgaaatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgt

SEQ ID NO: 1637 - DNA, 446 bp, Saccharomyces cerevisiae
ttttgtataactaaataatattggaaactaaatacgaatacccaaattttttatctaaattttgccgaaagattaaaatctgcagagatatccgaaacaggtaaatggatgtttcaatccctgtagtcagtcaggaacccatattatattacagtattagtcgccgcttaggcacgcctttaattagcaaaatcaaaccttaagtgcatatgccgtataagggaaactcaaagaactggcatcgcaaaaatgaaaaaaaggaagagtgaaaaaaaaaaaattcaaaagaaatttactaaataataccagtttgggaaatagtaaacagctttgagtagtcctatgcaacatatataagtgcttaaatttgctggatggaagtcaattatgccttgattatcataaaaaaaatactacagtaaagaaagggccattccaaattacct

SEQ ID NO: 1638 - DNA, 350 bp, Saccharomyces cerevisiae
gagagtagactttttctgtgaaatttaatgagtttttgttcaccttttttacttttcttctatgccatatggttaaataaaacatggttcaaacgcgattcttttttattatctatgtctttattatgtagtcttcactataataaccgttaatgagcgacatagttgcatcagtttttaaggccaatttgattcagaaccttttcaagttcttcactttccatcttatccgaagacgcgatctggtggcatctaatactatgcttctcgaatatcgtttcatcaatttcaatttcaccattttttaggtaaacaatatcagtaataaaatcttgccattcaaagtcatc

SEQ ID NO: 1639 - DNA, 224 bp, Saccharomyces cerevisiae
cgttcagggtaatatattttaaccgccgacgttctcgccataacttttaaacagtgataactaatattgaaacttagaaagaaaagggtaaagttaatgcttaatcttgtcttggcttaaaaagtaatatgtacttatttacgtcatcacaaaatctagcagaaaaacggtagtatttatgtatattcaaaaaaaaatcattatcctcatcaagattgctttat

SEQ ID NO: 1640 - DNA, 350 bp, Saccharomyces cerevisiae
aagggaaccttttacaacaaatatttgaaaaattacctccattattataccttctctttatgtaattgttagttcgaaaattttttcttcattaatataatcaacttctaaaactttctaaaaacgttctctttttcgagattagtgcttcttcccaatccgtaagaaatgtttcctttcttgacaattggcaccagctggctactcgttgctcgaaaactactctcttttatttttaatttacgaacgattatctttcgaaggaacgaccaaacgagctaaatatgggcatcgccaacgttaaaaaaatggaccctaccgaagacgttattatgccaaggcgcagcgaa

SEQ ID NO: 1641 - DNA, 351 bp, Saccharomyces cerevisiae
tgaacccgatgcaaatgagacgatcgtctattcctggtccggttttctctgccctctcttctattcactttttttatactttatataaaattatataaatgacataactgaaacgccacacgtcctctcctattcgttaacgcctgtctgtagcgctgttactgaagctgcgcaagtagttttttcaccgtataggccctctttttctctctctttctttctctcccgcgctgatctcttcttcgaaacatcatgaataaaaagaaaaaggaaatcaagaaaaaaaagccataatttatcccacatttttttttattgtcgctgttcacaccgcataacgaagatattggc

SEQ ID NO: 1642 - protein, 359 aa, Nepeta cataria; identical to SEQ ID NO: 561

SEQ ID NO: 1643 - protein, 355 aa, Nepeta cataria; identical to SEQ ID NO: 566

SEQ ID NO: 1644 - protein, 435 aa, Nepeta cataria; identical to SEQ ID NO: 578

SEQ ID NO: 1645 - protein, 889 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1646 - protein, 942 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1647 - protein, 909 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1648 - protein, 961 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1649 - protein, 937 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1650 - protein, 442 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1651 - protein, 495 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1652 - protein, 462 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1653 - protein, 514 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1654 - protein, 490 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1655 - protein, 906 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1656 - protein, 959 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1657 - protein, 926 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1658 - protein, 978 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1659 - protein, 954 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1660 - protein, 489 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1661 - protein, 542 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1662 - protein, 509 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1663 - protein, 561 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1664 - protein, 537 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1665 - protein, 898 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1666 - protein, 951 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1667 - protein, 918 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1668 - protein, 970 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1669 - protein, 946 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1670 - protein, 890 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1671 - protein, 943 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1672 - protein, 910 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1673 - protein, 962 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1674 - protein, 938 aa, Artificial Sequence
  source: /note="Description of Artificial Sequence: Synthetic polypeptide"
MGCIRSTTHTSTNYGINSRLGLSFPVPIIYRPAGASRNISIYMSSSAAPNVTQVVVGANDALLQYTHQPMLIPSEVDADTERRDYLLEKARQELSRTTKPTDKLKLIDMIQRLGIGFYLEDDINAILRTQFSVNVIDEEDLSATGLRFRMLRQNSFPISSDIFKRFQDQNEKFDETLTNDTLGVIELVRSIIHGEPKGEEILEEAMEFSKTRLKRSLSSLPAQIKADVGQALELPTHLRMARLEARRFIEQYATQSDHNPILLELATLDYNHVQSQHQMELVEITRWWKQLGLVDQLSFARDRPLECFLWTVGLLPEPKYSSCRIELAKTIAVLLVIDDIFDTYGKMDDLILFTDAIQRWDLGAMESLPEYMKICYMALYNLTNEICYKVLKENGWTVLPYLKSSWIDMIEGFMVEAKWFNGGCAPNLEEYVENGVSTAGSYMALVHLFFLIGEGVTEQNAQLLMKKPYPKAFSSAGRILRLWDDLGTAKEEQERGDLASSINLFMKERNLATEEEGRECILEDIYGYWKDLNGELVSQKEMPLAIIKVALNMARASQVVYKHEEDSYFSNVDNYVQALLFTPLIIGGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1675 - protein, 443 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1676 - protein, 496 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1677 - protein, 463 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1678 - protein, 515 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1679 - protein, 491 aa, Artificial Sequence
  source: /note="Description of Artificial Sequence: Synthetic polypeptide"
MQEAVAKVAQLIIIIDDIYDVYGTVDELELFTNAIDRWDLEAMEQLPEYMKTCFLALYNSINEIGYEILKEEGRNVIPYLRNTWTELCKAFLVEAKWYSSGYTPTLEEYLQTSWISIGSLPMQTYVFALLGKNLAPESSGGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1680 - protein, 907 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1681 - protein, 960 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1682 - protein, 927 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1683 - protein, 979 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1684 - protein, 955 aa, Artificial Sequence
  source: /note="Description of Artificial Sequence: Synthetic polypeptide"
MSSISQKVVIGLNKAAANNNLQNLDRRGFKTRCVSSSKAASCLRASCSLQLDVKPVQEGRRSGNYQPSIWDFNYVQSLNTPYKEERYLTRHAELIVQVKPLLEKKMEPAQQLELIDDLNNLGLSYFFQDRIKQILSFIYDENQCFHSNINDQAEKRDLYFTALGFRLLRQHGFDVSQEVFDCFKNDNGSDFKASLSDNTKGLLQLYEASFLVREGEDTLEQARQFATKFLRRKLDEIDDNHLLSCIHHSLEIPLHWRIQRLEARWFLDAYATRHDMNPVILELAKLDFNIIQATHQEELKDVSRWWQNTRLAEKLPFVRDRLVESYFWAIALFEPHQYGYQRRVAAKIITLATSIDDVYDIYGTLDELQLFTDNFRRWDTESLGRLPYSMQLFYMVIHNFVSELAYEILKEKGFIVIPYLQRSWVDLAESFLKEANWYYSGYTPSLEEYIDNGSISIGAVAVLSQVYFTLANSIEKPKIESMYKYHHILRLSGLLVRLHDDLGTSLFEKKRGDVPKAVEICMKERNVTEEEAEEHVKYLIREAWKEMNTATTAAGCPFMDELNVAAANLGRAAQFVYLDGDGHGVQHSKIHQQMGGLMFEPYVGGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1685 - protein, 490 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1686 - protein, 543 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1687 - protein, 510 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1688 - protein, 562 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1689 - protein, 538 aa, Artificial Sequence
  source: /note="Description of Artificial Sequence: Synthetic polypeptide"
MEEAKWFNRGYIPTLDEYLANGVISGGTCMALVHAFFLMGKGVMKETEAMMEPYPRCFTSSGKILRLWDDLGTSREEQERGDVASSIECLMNEKNIALEDGARKHVRQLIGSLWIELNGELVAPTGLPLSTIKASFNLSRTAQAIYQHGNDNTASSVQDHVQSLFFNPIGFQTRSPNHRNVTLSNRGGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1690 - protein, 899 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGGSMDFPQQLEACVKQANQALSRFIAPLPFQNTPVVETMQYGALLGGKRLRPFLVYATGHMFGVSTNTLDAPAAAVECIHAYFLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 1691 - protein, 952 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGGSMASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 1692 - protein, 919 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGGSMLRCSNTNAQLANLSEQVKGKVTEFDFKEYMRSKAMSVNEALDRAVPLRYPEKIHEAMRYSLLAGGKRVRPILCIAACELVGGSEELAMPTACAMEIIHTMSLIHDDLPCIDNDDLRRGKPTNHKVFGEGTAVLAGDALLSFAFEHIAVSTSKTVESDRVLRVVSELGRAIGSEGVAGGQVADITSQGNPSVGLETLEWIHIHKTAVLLECSVASGAIIGGASDDEIERVRKYARCVGLLFQVVDDILDVTKSSEELGKTAAKDLLSDKATYPKLMGLEKAKEFADELLGKAKEELSFFNPTKAAPLLGLADYIAQRQN

SEQ ID NO: 1693 - protein, 971 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGGSMKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 1694 - protein, 947 aa, Artificial Sequence
  source: /note="Description of Artificial Sequence: Synthetic polypeptide"
MAFNMSRFVTMPSHVLPSSFVAPSLQVSSSPCSWRTRPSPCTSCHLSPSSSSKPLLGSHDYSLLKSLTLSPHAVNSEADSSTRRMKEVKERTWEAFYRAWDSRAAMEMVDTVERLGLSYHFEDEINALLQRFCDWNASEDLFTTALRFRLLRQNGFPTHSDVFGKFMDKNGKFKESLTEDIRGMLSLHEASHLGAKNEEVLAEAKEFTRIHLIQSMPHMEPHFSSHVGRALELPRHLRMVRLEARNYIGEYSRESNPNLAFLELAKLDFDMVQSLHQKELAEILRWWKQLGLVDKLDFARDRPMECFLWTVGIFPDPRHSSCRIELTKAIAILLVIDDIYDSYGSLDELALFTDAVKRWDLGAMDQLPEYMKICYMALYNTTNDIAYRILKEHGWSVIEHLKRTWMDIFGAFLAEAYCFKGGHVPSLEEYLTNAVTTGGTYMALVHAFFLMGQGVTRENMAMLKPYPNIFSCSGKILRLWDDLGTAREEQERGDNASSIECYKREREMDTVLEDEACRKHIRQMIQSLWVELNGELVASSALPLSIIKAAFNLSRTAQVIYQHGDDNKTSSVEDHVQALLFRPVSSNGHAQITMHGGGGSMLAEEQLDPFSLVADELSLLADRLRSMVVAEVPKLASAAEYFFKMGVEGKRFRPTVLLLMATALNVPLPRPALAEVPETLSTELRTRQQCIAEITEMIHVASLLHDDVLDDAETRRGIGSLNIMMGNKVAVLAGDFLLSRACVALASLKNTEVVSLLATVVEHLVTGETMQMTSTSEQRVSMEYYLQKTYYKTASLISNSCKAIALLAGQTAEVSMLAFEYGKNLGLAFQLIDDVLDFTGTSASLGKGSLSDIRHGIITAPILFAIEEFPQLDAVVKRGLDNPADIDLALDYLGKSRGIQRTRELAMKHANLAAEAIDSLPESGDEDVLRSRRALIDLTHRVITRTK

SEQ ID NO: 1695 - protein, 391 aa, Phialophora attae
MAGGKKALIFGASGVTGWSFVNEILNDYPDKGIWDRVYALTNRPLTRSASKWPDDPRLRIVSGIDLLKGSQEDLEGELRSNVEDIEQITHVYYLAYKASKDVDQELKDAVAMFQRSTIALDKLSPALEFVVLQTGAKMYGCHLLDNHPTDYMSVPHKESTPRLKAPYHDQLFYHPQLDWVTEYARGKKWNWCDTRPDIIIGFVPNQNFYSLATSLAVFLSLYREVEGAGAECMFPGTSKSWVAKSNDSSSDMIARQTLHLSLTLPMDRKGEGFNVADARHPETFESKWPQICAYFGLKGIGPAKEPSNIRTYIREHFDTWRAIEKKHGLQSGIADSDLTFEGFEYFLLAQFDFDRQYDMTKMYDTGFTEERTVMEAWGGVFDRMRAAKLIP

SEQ ID NO: 1696 - protein, 390 aa, Tarenaya spinosa
MCGWWGAGAIGAAKKKLEEDEPPPRSYQSVGLIIGVTGIVGNSLAEILPLSDTPGGPWKVYGVARRPQPSWNADHPIDYIQCDVSDTDDVRCKLSPLTDVTHIFFVAWTNRGSEPENCETNAGMLRNVLRAIVPHAPNLRHVCSADWWRSITSDLRQPRRVLPRSAIHGGSTKVTDSELLLHPGGCPVRGGREERRLDLVCTPTEHDLWVLALQSDEYGGYSLCIRSNLQARGISIAIPRKQDCVGRIRGFFGCGFDSRAADLGSGDPYAGNEAFNCSNGDVFKWKHMWKVLAEQFGIEEFGFEEGKNVGLGKMMEGKERVWEEIVKENQLKKTKMEEVGVWWFADVILGVEGMIDSMNKSKEHGFLGFRNSKNSFISWIDKYKAYKIVP

SEQ ID NO: 1697 - protein, 282 aa, Trifolium pratense
MKKLIAKVRKKVAEHTSISLESSKENETTEPNGGTENKYPTMDEIWYINVVRRGDQSQSPFRSQSESQSGTQTLLCDLDEKKPKKKNKTSFHLSHIIAFELVCSQTSSHIWILTLQFDEYVVGTLCVYAAICKHGGVPLIFPGTKGAWENYYMASDADLIAEQHIWVAVDPYAKNEAFNCSNGDVFMWKQLWKVLAEQFGIEEYGYEEGSSLKLAELMKDKGPVWDEIVKVNELQPTKLEEVGEWWITDASFGLENIVDSMNKAKEHGFLGSEIVRILSLDR

SEQ ID NO: 1698 - protein, 337 aa, Oryza glumipatula
MLPMSMSWWWAGAIGAARKRHDGGGGEQQPPFRSVALVVGSTGIVGTSLVDILPLPDTPGGPWKVYALSRRPPPPWSPPPPAAVTHLCVDLADAAAVAEALAPLTDITHVFYVALAAPHLAEARSREANAGMLRNVLAAVVPTCPALAHVALQTGSKHYIGPPESIGKLAVETPFSEDMPRHDYPNFYYDQEDVLFDAVTSSSSSSSRRAAAVTCSGLGNSGTAACGTSGFGSSGTTGCGGSSCLGNSGTTAGCGGSSCLGNSGTTGCGGSSCLGSSGTAGCGGYSSSSHRAALLMELHESSSSAARKRTEEDMAFLLETMLVGELHSIGCSTCFDV

SEQ ID NO: 1699 - protein, 394 aa, Triticum aestivum
MMKWWWAGAFGAFKKRRASSRARAAAEAPQSNVALVVGSTGIVGAALIDILPLRDTPGGPWKVYALSRRPLPPWSAPLPPDVFHHHLDLADPAAVADALAPLTDVTHVFYVAWDPRPTHAEGREANGAMLRNVLSALVPNCPGLLHVCLQTGRKHYVDPFEPLTDVPLALRPYSEDLPRLDYPDLEDVLLDGLASNNRVTWSVHRPTTIFGFSPRSARNVVASLCVYAAICGKEGLVLRWPGSRVAWEGFSDASDAELVAEHALWAAMEPNGRNEPFNCSNGDLFKWQQLWPILASQFGVKWTGYQGEDQRFMLEEAMAGKEGVWSEIVNENGLVETELNDITNWFCVDAMVNVERENLDTMNKSKEYGFFGFRNTVRSFNTWINKMKVDKIVP

SEQ ID NO: 1700 - protein, 414 aa, Oryza glumipatula
MNDMSWWWAGAIGGVRKRHGEHAGDASRPFQSVALVVGSTVIVGTSLVDILPLPDTPGGPWKVYAVSRRPLPPWSPPPSPAVTHLCVDLADPAAVSAALAPLTDITHVFYVAWAPHFVEEDQNREANSRMLRNVLSAVVPNCPALVHVSVQTGSKHYIGPPESIGKFTIETPFSEDMPRLDNCPNLYYDQEDALFDAVSRSRRRGAAVISWSVHRPSLVFGFSPRSAMNVVCTLCVYAAICRKEGGRKLRWPGSLGAWEGFSNASDADLVAEQHIWAAVDPAARNEAYNYSNGDVYKWKQLWPVLAGRFGMEWSGYEGEESRVSLTEAMAGKEAAWAEIVREEGLVAAAELDQVANWWFVDALFMDKWEFLDTMNKSKEHGFLGFRNTVKSFGTWIDKLRLYKIVPSCRIVSSL

SEQ ID NO: 1701 - protein, 401 aa, Madurella mycetomatis
MPSAVVVGATGILGREIVKRLAHRPDEWKTVYALSRSKKDEYPPNVTHNHVDLVRSADQMAQQLKGIEAEYVFFAAYLQKNTEEENWQINGDMLDNFLKALEITGAVNKIKRILLVTGCKQYGVHLGQAKNPMVETDSWLRDDPFPPNFYYRQQDILKSFCEKHQAISWVVTYPNDVIGFANGNFMNLAEGLGIYAVVSKELGQDLVFPGSETFYSRFDSFTSSKLHAEFCEWAIREPRAANQAFNVVNGDVQTWQDLWPRLARRFGLKVKADQFAGDTGLSSKTRLGAQPPISVFAEEAGLAGRIPPSELEQRISLVKWSQQENVQKAWRRLAEREKLQEDALEKGTWAFIDFVLGRNYDIVVSMSKAREAGWTGYQDTWKSLSDVFGELEAASVLPKIH

SEQ ID NO: 1702 - protein, 244 aa, Phaedon cochleariae
MQPYTFPDDFVFCDLESPDLSTCLRDKLQNWTTMLGTRGINHPIRFTLEPMVIDFWVLNMNLNFLNSTEYLWNCTFSQFWNSTVISASYNPENYTLVYTSYYPHIIEHGRYQMFGTVSFEDGSVDAIYGNGPYDKHIYGLNLTHKITFVPVLREHGVEYLQVSRYELDSDGFRDTSLQWHNLYNGDTIRGNRTVTRLAHNAMALGGALAKPFTDMTIAMFRLYTENLISSVPRRQLRRHFSRHP

SEQ ID NO: 1703 - protein, 372 aa, Glycine max
MSKLNEAPQSVALVLGVTGIVGNSLAQILPLSNTRGGPWKVYGVARRTQPSWNALNTVHYIQCDISDQNDAESKLSSLTDVTHVFYVCWARRPTEAQNCQVNGAMLRNVLRAVIPNAPNLRHVSLQTGTKHYLGPFELLGKIEVAHDPPFTEDLPRLDAPNFYYTQEDILFEEVRKKGLTLTWFVNRPHFIFGFSPYSLMNLVGTLCVYAAICKHEGVPLWFPGTKAVWECYNTASDADLIAEQHIWGAVDPRAKNEAFNCSNGDVFKWKHVWKVLAERFGIREYGFLEGEDLRLSEMMKEKGAEEIVKKNGLQRTKLEDVGDWWFADLILRMEAVLDSMNKAREHGFFGFRDSKKSFMNWIDKTKACKIVP

SEQ ID NO: 1704 - protein, 463 aa, Triticum aestivum
MSLSGHNDVLLCRETAARSSPSVAAFSLSQQEGRTRSLLLPPTAGRSTQAPLTVTVTAATPPSSRDELVVGGRGRRRQETPGRQRRRSRARLLERRPRRRIHGHRRHIAPRHPPAPRHPRRALEGVRAVSRRALPPWTPPPTPAVTHLRVDLADPAAVAEALAPLTDITHVFYAAWSSHRTEAENREANAAMLRNVLSVVVPGCPALAHVCLQTGRKHYVAPFESIGKIPGVPDPPYTEDMPRLDCPNFYYDQEDVLFDEVSRRDGAVSWSVHRPTLIFGFSPRSAMNVVGSLCVYAAICCKEGATPRWPGSRVAWEGFTDASDADLVAEHEIWAAVDPFTKNEAFNCSNGDVFKWKQLWPMLADHFGLEWAGYEGEDGRFIIADAMARKEAVWAEIVQENELVTTELKEITNWWFVDAVLNFEVEHLDSMNKSKEHGFLGFRNTANSFNAWIGKLKASKIVP

SEQ ID NO: 1705 - protein, 389 aa, Olea europaea
MSWWSTRAIGAAKKKFEEDEAPIKHQSVALVIGVTGIVGNSLAEILPLADTPGGPWKVYGVARRPQPSWSEDNPIQYIRCDISDHEDAQAKLSPLTDVTHIFYVTWTNKSTEAENCEANGKMFKNVLEAVISNCPNLKHICLQTGRKHYVGPFESFGKIKFHDTPFHEDLPRLDCPNFYYTMEDILFEEVEKREGLTWSIHRPGLIFGFSPFSMMNLVGTLCVYAAICKHEGMPLRFPGSEVVWDGYYDCSDADLIAEHQIWAAVDPYARNEAFNISNGDVFKWKHFWRILAEQFGVEYEEFEEGQNLTLLAMMKDKGKVWDEIVRENGLTPTKLEDVGVWWLADTMLSLKCLLDTMNKSKEHGFLGFRNSKNSFISWIDKLKAYKIVP

SEQ ID NO: 1706 - protein, 390 aa, Camptotheca acuminata
MSWWWAGAIGAAKKKFEEDGGPKVFQSVGLIVGVTGIVGNSLAEILPLSDTPGGPWKVYGVARRTRPPWNVDHPVEYIQCDISDADDALAKLSPLTDLTHIFYVTWANRSTELENCESNGTMLRNVLRAVIPNAPNLSHICLQTGTKHYIGPFESFGKVQPHEPPFTEDMPRLDAPNFYYTLEDVLFEEAAKKEGLTWTIHRPQVIFGFSPYSMMNIIGTLCVYAAICKHENTPLKFPGSKTAWNCYSNASDADLIAEHQIWAVVDPYAKNEAFNCSNGDVFKWKHLWKVLAEQFDVDYVECDESEKPVSLEEMMKEKGPVWDEIVKERELVPTKLEEVGMWWFVDVIFAGEAMLDSMNKSKEHGFSGFRNSKNSFISWIDKVKDYKIVP

SEQ ID NO: 1707 - protein, 347 aa, Musa acuminata
MSWWWAGAIGAAKKKTTGDDADAPAARYQSVALVVGATGIVGSSLYDILPLADTPGGPWKLSPLGDVTHIFYAAWCRRSTAAETRATNAAMLRNVLDAVLPAAPNLQHVCLQTGRNHYLGPYGPAGGVVAEVGPRHDPPHDPPFPENTPRLAIPNFYYELEDVLLEELAKKERAVTWSVHRPTTIFGFSPCSLMNLVCSLCVYASICRKEGVPLRWFGSEEAWYGFSDASDADLVAEHQIWAAVDPYAKNEAFNCSNGDVFKWKHLWPDAMKGKEAVWEDIVRENELVPTALDEVGHWWYADAVLGLEFEHLDNMNKSKEHGFLGFRNSVTSFNTWIDKLRAYKVVP

SEQ ID NO: 1708 - protein, 387 aa, Arabidopsis thaliana
MSWWWAGAIGAAKKLDEDEPSQSFESVALIIGVTGIVGNSLAEILPLSDTPGGPWKVYGVARRPRPTWNADHPIDYIQCDVSDAEDTRSKLSPLTDVTHVFYVTWTNRESESENCEANGSMLRNVLQAIIPYAPNLRHVCLQTGTKHYLGPFTNVDGPRHDPPFTEDMPRLQIQNFYYTQEDILFEEIKKIETVTWSIHRPNMIFGFSPYSLMNIVGTLCVYAAICKHEGSPLLFPGSKKAWEGFMTASDADLIAEQQIWAAVDPYAKNEAFNCNNADIFKWKHLWKILAEQFGIEEYGFEEGKNLGLVEMMKGKERVWEEMVKENQLQEKKLEEVGVWWFADVILGVEGMIDSMNKSKEYGFLGFRNSNNSFISWIDKYKAFKIVP

SEQ ID NO: 1709 - protein, 389 aa, Digitalis lanata; identical to SEQ ID NO: 370

SEQ ID NO: 1710 - protein, 263 aa, Musa acuminata
MSWWWAGAIGAARKKLDDDFSAAAPRHQSVALVIGATGIVGSSLIGILPLPDTPGGPWKVYGVSRRSPNPNLSPLSDVTHTGRKHYIGPFESIGKISAHDPPFHEDLPRLNVPNFYYDQEDILFDELSKRDGAVTWSIHRPGTIFGFSPTSLMNIIGTLCVYAAICRKEGAPLKWFGSRTAWDGFSDASDADLIAEHQIWAAVDPYAKNEAFNCSNGDGEEGRFKLEDAMREKDKEHGFLGFRNTLTSFNSWIDKMKAFRIVP

SEQ ID NO: 1711 - protein, 346 aa, Musa acuminata
MSWWWAGAIGAARKKLEDDSSSTVPKYESVAIVIGATGIVGTSLVDILPLADTPGGPWKVYAAPVAADTLRVQHIQCDVLDAADAVAKLSPLTDVTHLFYVAWANRLTEAENRVVNSAMLRNVLSAVVPSAPNLCHVCLQTGRKHYVGPFEAVGKALAHDPPFREDLPRLPVPNFYYDQEDILFDELSKKEGAVTWSIHRPTTIFGFSPTSLMNLIGTLCVYAAICRKEGAPLKWFGSRTTWDGFNDASDADLIAEQQIWAAVDPYAKNEAFNISNGDLFKWKHLWAALADQFGLESVGYEGEASRFKLEDAMRGKEAEHGFLGFRNTVASFNSCIDKMKAFKIVP

SEQ ID NO: 1712 - protein, 396 aa, Anthurium amnicola
MSWWWAGAIGAARKKLEEEEDTGGGPRRYQSVGLVVGVTGIVGNSLAEILPLSDTPGGPWKVYGVARRPRPAWNLADHPVEYIQCDVSDADDARAKLSPLTDVTHLFYVTWSSRPTEAENCEVNARMLRNVLATLIPVCPGLRHVCLQTGRKHYIGPFELVGKIPTADPPYHEDLPRLECPNFYHDLEDVLFETAAKAGSLTWSVHRPGFIFGFSPYSIMNVMGSLCVYAAICKHEGIPLRYPGNRVVWEGYSNASDADLIAEHQIWAAVDPYAKNEAFNCSNGDVFKWKHLWRVLAEQFGLDYVGYEGEEGRFGVAEAMAGKGPVWDAIVKENELSQTRLEEVAQWWFVDLLVNCEDTHLDSMNKSKEHGFLGFRNSVNSFIYWIDKMKAYKIVP

SEQ ID NO: 1713 - protein, 393 aa, Cinchona ledgeriana
MSWWWAGAVGAARKTLGQDGAPRSKNFQSVALIIGVTGIVGGSLAEILPLSDTPGGPWKVYGVARRPRPSWNLDHPVEYIQCDVLDAGDTRAKLSPLSDITHIFWVTWANRPSEAECIKVNGAMFQNVLNSVVPNAPNLSHICLQTGHKHYIGPFEAFGKIKPHETPFIEDVPRLNAPNFYYTLEDMLFDACNKSKGLLTWSVHRAAVIFGFSPCSMMNLVGSLCVYAAICKDENVPLKFPGTKAAWNCYSVASDADLIAEHQIWSAVDPYAKNEAFNCSNGDVFKWKHLWKVLAEQFEVEYAEFDENEKFVSLAERMKNKGPVWDEIVKKNQLTPTKLEEVATFWFADVIFSGECLLDSMNKSKEHGFLGFRNTSKSLISVIDKMKAYKIVP

SEQ ID NO: 1714 - protein, 429 aa, Triticum aestivum
MSWWWAGAVGAVKKRQDERAAAAEPTFQSVALILGSTGIVGTSLLDILPRDDTPGGPWKVYAVSRRAPPGWSTPPPSPAVTHLQLDLADPAAVRDALTPLTDVTHVFYAAWSSHETEDRNREVNAGMLRNVLSVVVPGCPALAHVCLQTGRKHYVGPFDVIGKIPAPDPPYTEDMPRLDHPNFYYDLEDVLFDHVSGRDGAVTWSVHRPTVIFGFSPRSAMNVVGSLCVYAAICRKEGATLRWPGCKVAWEGFTDASDADLVAEHEIWAAVDPFAKNEAFNCSNGDVFKWKQLWPLLADRFGVEWAGYEGEDSRFALADAMAGKEAVWTEIIQENELVTTELEEITSWWFVDAMLSIDIEHLDNMNKSKEHGFLGFRNTINSFNAWIDKMKASKCYASVFKTEIVSFKTRRTKAKYSQEVNAQKQQTLL

SEQ ID NO: 1715 - protein, 341 aa, Aegilops tauschii
MSWWWAGAVGAVKKSQEERTEPSFQSVALVVGSTGIVGTSLVDILPRHDTPGGPWKAHPTEAQNREANSAMLRNVLSVVVPGCPALAHVCLQTGRKHYIGPYEAIGKIPVPDPPYTEDMPRLDYPNFYYDQEDVLFEEVSRRDGAVSWSVHRPSVVFGFSPRSAMNVVASLCVYAAICRKEGAMLRWPGSRVAWEGFSDASDADLVAEQEIWAAVDPLAKNEAFNCSNGDLYKWKQLWPMVADRFGVEWAGYEGEESRFMLADAMAGKEAVWAEILQENELVTTELQEIANWWFLDAVFNVKCEHLDSMNKSKEHGFLGFRNTAKSFNAWIDKMKVLKIVP

SEQ ID NO: 1716 - protein, 391 aa, Vinca minor
MSWWWAGAVSAARKISDENYEAPKKFQSVALIIGVTGIVGNSLAEILPLSDTPGGPWKVYGVARRPRPAWNSDHPVEYIQCDVYSSEETQSKLSPLTDVTHIFWTTWANRPTEAQCIEVNGSMFQNVIDALLPNAPNLSHICIQTGHKHYIGPFESFGKIKPHDTPFIEDVPRLDVPNFYHTLEDIAFDACNKKEGLTWSVHRPAVIFGFSPNSMMNLIGTLCVYATICKHENVPLTYPGTKAAWNCYSVASDADLIAEHQIWAAVDPYAKNEAFNCSNGDIFKWKHLWKVLSEQFEVEFVEFDENQEYVSLSERMKGKGQVWDEIVKKNQLLPTKLEEVATFWFADVILGFECLLDSMNKSKEHGFLGFRNTEKSLISVVDKMKAHKIVP

SEQ ID NO: 1717 - protein, 391 aa, Cinchona pubescens; identical to SEQ ID NO: 386

SEQ ID NO: 1718 - protein, 393 aa, Ophiorrhiza pumila; identical to SEQ ID NO: 387

SEQ ID NO: 1719 - protein, 390 aa, Swertia japonica
MSWWWKRSVQAQNLPEKNQPNGVAETAGRYESVALVVGVTGIVGSSLAQVLKLPDTPGGPWKVYGVARRPCPAWLAKFHVEYIQCDVSNTEEAKTKLSPLKDVTHIFYVSWIGSEDCETNAVMFKNILYNIIPVAPNLKHISLQTGSKHYFGIFEEGSEDVPHESPYTEDLPRLNIPNFYHDLEDILFEETAKHGLTWCVQRPALIFGFSPCSLMNIVSTLSIYATICKHENKPLVYPGSKASWNCYVDGADADLAAEHHIWAAVDPKARNQVFNVKNGDVFKWKNVWKMLADEFEIEMVGYIEGNEQVSMAELMKDKDGVWDEIVKKHKLEDTKLKEIAAFWFADIAFSCVDLVMSVTKSREFGFLGFRDSMKSFKSCIHKMRDFKFIP

SEQ ID NO: 1720 - protein, 391 aa, Lonicera japonica
MSWWWSGAIGAAKKKFDDDDAPKGFQSVALVIGITGIVGNSLAEILPLSDTPGGPWKVYGVARRPRPSWNADHPVEYIQCDISDTEQTLTKLSPLTDVTHIFWNTWANGGAEAVCCEINGTMLKNVLAAAIPNAPNLRHICLQTGHKHYIGPFESFGKITPHDTPFVEDVPRLNVTNFYYTLEDITAEAAARKNGALTWSVHRPAVIFGFSPYSMMNLVGTICVYAAICKHEKAPFKFPGTKAAWDCYSVASDADLIAEHQIWAAVDPNAKNEGFNCSNGDLFKWKHLWKVLAEQFEVEYVEFDENEAAVSLSERMKEKGPVWEDMVKENGLTPTKLEEVASFWFADVIFSGECMLDSMNKSKEHGFLGFRNTKNSLINVIDKMKAYKIVP

SEQ ID NO: 1721 - protein, 388 aa, Rauwolfia serpentina
MSWWWTRSIGAGKNLREQNKENGVSESYKSVALVVGVTGIVGSSLAEVLKLPDTPGGAWKVYGVARRPCPAWLAKKQIEYVQCDVSNTEETTAKLSPLKDLTHIFYVSWIGSEDCQINATMLRNILDAVIPNAQNLQHVCLQTGIKHYFGIFEEGSEVEPHDSPFTEDLPRLNVPNFYHDLEDILYEETAKNNLTWSVHRPALVFGFSPCSMMNIASTLSVYATICKHENKPLVYPGSKKSWNCSADAVDADLVAEQEIWAAVDPKAKNQVLNCNNGDVFKWKHIWKTLAEQFGLEMVGYVEGKEQVSLAELMKDKDSVWDEIVKKHNLVPARLKDIAAFWFADIAFSSENLLSSVNKSKEHGFLGFRNSMKSFVSCIDKMRDYKFIP

SEQ ID NO: 1722 - protein, 406 aa, Lonicera japonica; identical to SEQ ID NO: 388

SEQ ID NO: 1723 - protein, 414 aa, Oryza sativa
MVSSALPRGEPVTHICVDLADPAAVSAALAPLTDITHVFYVAWAPHFFEEDQNREANSRMLRNVLSAVVPNCPALVHVSLQTGSKHYIGPPESIGKFTIETPFSEDMPRLDNCPNLYYDQEDALFDAVSRSRRRGAAVISWSVHRPFPRVRLLPAERHERGVHPLRVRGHLPQGGRQEAPVAGVARRVGRVQQRVRRGPRRGAAHLGGRRPGGEERGVQLQQRRRLQVEAAVDGARRQVRDGVVGVRGGGEQGEPDGGGIVREEGLVAAAELDQVANWWFVDALFMDKWEFLDTMNKSKEHGFLGFRNTVKSFGTWIDKLRLYKIVPSCRIGEPDGGGIVREEGLVAAAELDQVANWWFVDALFMDKWEFLDTMNKSKEHGFLGFRNTVKSFGTWIDKLRLYKIVPSCRIVSSL

SEQ ID NO: 1724 - protein, 265 aa, Phaedon cochleariae
MWFTNILVVLIVGVALVKSSHAQPYTFPDDFVFCDLESPDLSTCLRDKLQNWTTMLGTRGINHPIRFTLEPMVIDFWVLNMNLNFLNSTEYLWNCTFSQFWNSTVISASYNPENYTLVYTSYYPHIIEHGRYQMFGTVSFEDGSVDAIYGNGPYDKHIYGLNLTHKITFVPVLREHGVEYLQVSRYELDSDGFRDTSLQWHNLYNGDTIRGNRTVTRLAHNAMALGGALAKPFTDMTIAMFRLYTENLISSVPRRQLRRHFSRHP

SEQ ID NO: 1725 - DNA, 1080 bp, Nepeta cataria
atggcgaaaaccccagaaacagagcacccagtgaaggcctttggctatgcggccactgacaattctggcaccttctctccgttcaagttttctcgccgcgctactggtgagcgtgatgtgcagttcaaggtgctgtattgtggtgtttgccattcagatctgcacatggtcaagaatgagtggggtgtcactcactacccgatcgttccggggcatgaaattgtgggcgttgcaactgaagttggtagcaaggttgaaaaggttaaggttggcgacaaagttggtgtcggcgtgattgtgggttcatgccgccagtgtgatcagtgcagcaatgatctggaaaactactgctccaagcaaattctgacctacggtgccccttatctggatggcaccattactcgcggcggctactctgatatcatggtggcagacgagcatttcatcatccgttggcctgaaaacttcccgctggatgctggcgctcctctgctgtgcgctggcatcacaacttacagtccactgcgctactttggcctggacaaacctggcctgcgcgttggtgtcaacggtctgggtgggctgggccacgtagctgtcaaattcgccaaagcttttggtactaaggtcacagttatcagctcatctctgcgcaagaagaaggaagctgttgaaaaactgggtgtagatgagtttctggtcagtactgatccagagcagatgcaggctgcaattggcacactggatggcatcattgacacagtctccgcggaacattcagttgtgtctctgctgagtctgctgaagccacacggccgcctgattgtggttggtgcaccggaaaagccgcatcagctgcctgctttcccgctgatcactggtcgcaagtccatttctgggagtgcaatcggcgggatgaaggagacgcaagaaatgattgatttcgcggccaagcacaacattctgccggatgtggaggtcattccgattgattacattaacacggctatggaacgcctgctgaaatcggatgtgaagtatcgcttcgtgattgatgttgagaaatcactgaaggcttga

SEQ ID NO: 1726 - DNA, 1068 bp, Nepeta cataria
atggcgaaatcagtgaacgccgtcggctgggccgcccgcgacacctccggcctgctgtcccctctgaaattcgcccgcccggccgccggcgaccgcgacgtccagttcaaggtcctgtactgcggcatctgccactccgatctgcacagcatcaagaacgagtggggcaacacccaatacccgatcgtcccgggccacgagatcgtcggcgtcgtcaccgccgtcggcccgaaggccaccaaattcaaggccggcgacaaagtcggcgtcggctgcctggtcaattcctgccgccattgcgaccaatgcgccgccgatctggagaattactgcccgcagctggtccaaacctacaatagcgtcctggccgacggctccgtcacctacggcggctactccgatgtgatgacggcggacgaagacttcgtcatccgctggccggagaatttcccgatggataagggcgccccgctgctgtgcgccggggtgacgacgtacagcccgctgcgctactacgggctggacaagccgggcctgcacatcggcgtcgtcgggctgggcgggctgggccatgtggcggtcaagtttgctaaggccttcgggatgaaggtgacggtgatcagcacctccgccgggaagaagaaggaggcaatcgagacgctgggcgccgacgcgttcctgatcagccgcgacgcgtcggagatgcaggcggcggcggggacgctggacgggatgattgatacggtctcggcccagcatccgctgccgccgctgctgagcctgctgaagccgcacgggaagctgattctggtgggcgcgccggagaagccgtttgagctgccggcattcccgctgctgatggggcgcaagactgtggcggggagtgtgattggcgggctgaaagagacgcaggagatgatcgatttcgcggcaaagcataatctgctgccggaggtggagatgattccgatggactacgtgaacacggcgatggagcgcctggctaaagccgacgtcaagtatcgctttgtgattgatgtggggaatacgctgactaaagccgattga

SEQ ID NO: 1727 - DNA, 1308 bp, Nepeta cataria
atggcattttgccgcagctcactgctgctgcgcaaggccctgggtggcagccgccgtgcggcggccgcggccacgtgctcttccgcctacgcttgcggctggcagtcggagcgcgggcgctggtactccggcggtgaagggacgaccatttcagcgccggggtaccacgtgaacaccgcgccgtcgcacatgacgggggcggtgttttgggataaggataagccgattacttatgaggagtttgagatgccacgcccgaaggccaatgaagttctgatcaaaactaaggcttgtggggcgtgccactcggatctgcacgtgatcaaaggcgacctgaaattcccgtgcccttgcatcctgggccatgagattactggtgaagtggtcgaacatggcccgctgaccgaaactaaatacattgaacgctatccagttgggtctaaagtgattggggctttcattatgccgtgcggcagttgtttctactgctcacgcggtgaagatgacctgtgtgagccttattttgcttataaccgcgcaaaaggcacactgtacgatggtcaaacacgcctgtttctgcgtggcagtggcaaaccggtgcatatgtggagcatgagtggtctggctgagtactgtgtgacgccagtaaacggcctgggtgcgctgccagacacactgccttatgccgaatcttcggtcctgggctgtgcagtttttactgcatatggtgcaatcgctcatgctgctgaggtcaaacctggtaactccgttgccgttatcgggatcggcggcgttggctcaagttgtctgcagattgcaaaggcatttggggcttcagagattatcgcagtggatgttgaagatggcaagctggaaacagctaagacatttggcgctactcatattattaattcacgcaaggaggatgctattgctaagattaaggaactgacagatggtcgcggtgtggacattgctgtggaagccattggggggccaaaaacatttgcacaatgtgtaggcagtgttcgcgcaggcggcaaagctgtgatgattggcctgtcaccgaccggtggtaaaggcgaggtcgaaattacccagctggttcgccgcaaggtaaaagtcattggctcttatggcgggcgcgcaatgacagacctgccaaaactggtagagctggcagagcaaggtacattcaatctggaggctgcagttacacgccgctacaaattcgaagaggtggcacaagcatatcaagacctgcaaaacaagaccatcgttggtcgcggcgttattgaaattatgtaa

SEQ ID NO: 1728 - DNA, 2667 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1729 - DNA, 2826 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1730 - DNA, 2727 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1731 - DNA, 2883 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1732 - DNA, 2811 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1733 - DNA, 1326 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1734 - DNA, 1485 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1735 - DNA, 1386 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1736 - DNA, 1542 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1737 - DNA, 1470 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1738 - DNA, 2718 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1739 - DNA, 2877 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1740 - DNA, 2778 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1741 - DNA, 2934 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1742 - DNA, 2862 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1743 - DNA, 1467 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1744 - DNA, 1626 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1745 - DNA, 1527 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1746 - DNA, 1683 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1747 - DNA, 1611 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1748 - DNA, 2694 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1749 - DNA, 2853 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1750 - DNA, 2754 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1751 - DNA, 2910 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1752 - DNA, 2838 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1753 - DNA, 2670 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1754 - DNA, 2829 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1755 - DNA, 2730 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1756 - DNA, 2886 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1757 - DNA, 2814 bp, Artificial Sequence
  source: /note="Description of Artificial Sequence: Synthetic polynucleotide"
atgggttgcatccgttccaccactcacacctccaccaactacggcatcaactcccgtctgggcctgtcctttccagtgccaatcatctaccgtccagcaggcgcatcccgtaacatctctatctacatgtcctcctccgcagcaccaaacgtgacccaggtggtggttggcgcaaacgatgcactgctgcagtacacccaccaaccaatgctgatcccatccgaagtggatgcagataccgaacgtcgtgattacctgctggaaaaggcacgtcaagaactgtcccgtaccaccaagccaaccgataagctgaagctgatcgatatgatccagcgtcttggcatcggcttctacctggaagatgatatcaacgcaatcctgcgtacccagttctccgtgaacgtgatcgatgaagaagatctgtccgcaaccggcttgcgtttccgtatgctgcgtcagaactcctttccaatctcctccgatatcttcaagcgtttccaggatcagaacgaaaagttcgatgaaaccctgaccaacgataccctgggcgtgatcgaactggtgcgttccatcatccacggcgaaccaaagggcgaagaaatcctggaagaagcaatggaattctctaagacccgtctgaagcgttccctgtcctccttgccagcacagatcaaggcagatgtcggccaggcattggaactgccaactcacttgcgtatggcacgtctggaagcacgtcgtttcattgaacagtacgcaacccagtccgatcacaacccaatcctgttggaattggcaaccctggattacaaccacgtgcagtcccagcaccagatggaactggtggaaatcacccgttggtggaagcagctgggccttgtggatcagctgtccttcgcacgtgatcgtcctctggaatgcttcctgtggaccgtgggcctgctgccagaaccaaagtactcctcctgccgtatcgaattggccaagaccattgcagtgctgctggtgattgatgatatcttcgatacctacggcaagatggatgatctgatcttgttcaccgatgcaatccagcgttgggatctgggtgccatggaatccctgccagaatacatgaagatctgctacatggcactgtacaaccttaccaacgaaatttgctacaaggtgctgaaagaaaacggctggaccgtgctgccttacctgaagtcctcctggatcgacatgatcgaaggcttcatggtcgaagcaaagtggttcaacggtggctgcgcaccaaacttggaagaatacgtggaaaacggcgtgtccaccgcaggctcctacatggccctggtgcacctgttctttctgatcggcgaaggcgtgaccgaacagaacgcacagctgctgatgaagaaaccttatccaaaggcattctcctccgctggccgtatcctgcgtttgtgggatgatttgggcaccgcaaaagaagaacaagaacgaggcgatctggcatcctccatcaacctgttcatgaaagaacgtaacctggcaaccgaagaggaaggccgtgaatgcatcttggaagatatctacggctactggaaggatctgaacggcgaattggtgtcccagaaagaaatgccactggcaatcatcaaggtggcactgaacatggctcgtgcatcccaggtcgtgtacaagcacgaagaagattcctacttctccaacgtggataactacgtgcaggcactgctgttcaccccactgatcatcggcggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1758 - DNA, 1329 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1759 - DNA, 1488 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1760 - DNA, 1389 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1761 - DNA, 1545 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1762 - DNA, 1473 bp, Artificial Sequence
  source: /note="Description of Artificial Sequence: Synthetic polynucleotide"
atgcaggaagcggttgcaaaagtcgcacagttgatcattatcattgatgatatttacgatgtctacggcaccgtggatgaactcgaactcttcaccaatgcaattgatcgctgggatctggaagccatggaacagctgccagaatacatgaagacgtgttttctggcgctgtacaactctattaacgagatcggatacgaaatcctcaaggaggagggacgaaacgtgattccgtatctgcgtaatacttggaccgagctctgcaaagcattcctggttgaagctaagtggtactcctccggctatacccccacactcgaggaatatctccagacctcctggatcagcattggctcgctgccgatgcagacctacgtgttcgccttgctgggaaaaaacttggcacctgaaagcagcggcggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1763 - DNA, 2721 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1764 - DNA, 2880 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1765 - DNA, 2781 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1766 - DNA, 2937 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1767 - DNA, 2865 bp, Artificial Sequence
  source: /note="Description of Artificial Sequence: Synthetic polynucleotide"
atgtcgtccatctcgcagaaggtggtcattggcttgaacaaagcggcagccaacaacaaccttcaaaatctcgaccgccgcggcttcaagactcgctgcgtgagcagctccaaagcagcctcttgtcttcgcgcttcctgctcgctccaactcgacgtgaaaccagttcaggaaggccgtcgttccggcaactaccaaccatcaatttgggactttaattacgtacagagcttgaacacgccatacaaggaagagcgttacctcacccgacacgctgagctgattgtccaagtaaaacctctcctggaaaagaaaatggaaccagcgcagcaactggaacttatcgatgatttgaataaccttggcctgtcctacttctttcaagaccgcattaaacagatcctctccttcatctacgatgaaaaccagtgctttcactccaacatcaacgatcaggcagaaaaacgtgacctgtactttacagctttgggcttccgactcctgcgacagcacggcttcgatgttagccaggaagtgttcgattgcttcaagaatgacaacggttctgacttcaaggcctccctctctgacaataccaagggcctgctccagttgtatgaagcatccttcctcgtccgcgaaggtgaagacactctggaacaagcgcgtcaattcgcaactaagttcctgcgccgcaagcttgatgagatcgacgataatcatctgctgtcttgcattcaccattcactcgagattccgcttcactggcgcatccagcgcctcgaggctcgctggtttctggatgcttacgcaacccgccacgacatgaacccggtgattctggaacttgcaaagctggatttcaacatcatccaagcgacccaccaggaggaactcaaggacgtgtcccgttggtggcagaacacacgacttgcagaaaaactgccatttgtgcgtgaccgtctggtcgaatcctacttttgggctatcgcactcttcgaaccgcatcagtacggctaccagcgccgtgtcgccgcaaagattatcacccttgcaaccagcatcgatgacgtatacgatatctacggcaccttggacgaactgcaactgttcaccgataacttccgccgctgggacaccgaatcgttgggccgcttgccttattccatgcaactgttctatatggtgatccataactttgtatcagaattggcatacgagattctcaaagaaaaaggcttcatcgtcatcccctaccttcaacgctcttgggtcgatttggcggaatccttcttgaaagaagcaaattggtactactcaggctacacgccatcactcgaggagtatatcgataatggctcgattagcatcggcgcagtcgccgttctttcccaggtttacttcaccttggcgaactccattgaaaaaccgaagatcgaatccatgtataagtatcaccatatcctgcgcctcagcggactccttgttcgtctgcacgacgatcttggtacgtcacttttcgaaaaaaaacgtggcgacgtgccgaaagccgtcgagatttgcatgaaggagcgtaacgtgactgaagaggaggctgaggagcacgttaaatatctcatccgcgaagcctggaaagagatgaacaccgcaaccactgctgcaggatgtccattcatggacgagctcaacgttgcagcagcaaacctcggtcgcgcggcacaattcgtgtacttggatggcgatggtcacggagtgcagcactctaaaattcaccagcagatgggcggcctcatgttcgaaccctacgtcggcggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1768 - DNA, 1470 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1769 - DNA, 1629 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1770 - DNA, 1530 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1771 - DNA, 1686 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1772 - DNA, 1614 bp, Artificial Sequence
  source: /note="Description of Artificial Sequence: Synthetic polynucleotide"
atggaagaagcgaagtggttcaaccgtggatacatccctaccctggatgaatacttggcaaacggcgttatttccggcggtacttgtatggctttggtccacgcgttctttctgatgggtaaaggagtcatgaaggaaacggaagcaatgatggaaccataccctcgttgctttacatcttccggtaaaatcctccgcctgtgggatgacctcggcacctcccgcgaggaacaggagcgaggcgacgtagcttcctccatcgaatgtctgatgaacgaaaagaacatcgccctcgaagacggagctcgtaaacacgttcgccaactgatcggttccctctggatcgaactcaatggcgaactggtggcacctacgggtctgccgctctctaccatcaaggcatccttcaatctgtcccgcaccgcccaagcaatttaccaacacggtaacgataacacagcgtcatcggtacaagatcatgtgcagtccctgttcttcaacccgatcggcttccaaacccgctccccaaatcatcgtaacgtcacactctccaaccgcggcggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1773 - DNA, 2697 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggcggctccatggactttccccaacagctcgaagcctgtgtgaaacaggctaaccaggccctgtccagatttatcgccccccttcccttccagaacactcccgtggtagagactatgcagtacggagccctgctcggcggcaagcgattgcgacccttccttgtgtacgccaccggccatatgttcggcgtttctactaacacgctcgacgccccggctgctgccgtggagtgtattcatgcttacttcctgatccacgatgatctgccagccatggatgacgatgatttgcgtcgaggcctcccgacctgccacgttaagttcggcgaggcaaacgctatcctcgctggcgacgcccttcagacacttgcattctccattctgtcagatgctgatatgcccgaggttagtgatagagatcgtatctcgatgatttctgagctggctagcgcatcgggaattgccggcatgtgcggtggtcaggctcttgatttggatgccgagggcaaacatgtcccgctggacgctttggagaggattcatagacacaagacaggtgctctcatccgcgccgccgtccgactgggcgccttgtccgctggcgacaagggtcgacgagccctcccagtcctcgataagtatgctgaatccattggcttagccttccaggtgcaggacgacattctcgacgtcgtgggcgacacggccaccctcggaaaaagacagggcgctgaccagcaactgggcaagtcgacgtaccccgcgcttctgggcctcgaacaagcccgtaagaaggctagagacctcatcgacgacgcgcgtcagtccctcaagcaactggccgagcagtctttggacactagtgctctcgaagctttggctgactacattatccaacggaacaaa

SEQ ID NO: 1774 - DNA, 2856 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggcggctccatggcctctgagaaagagatccgacgggagcggttcctaaatgtgttccccaagttggttgaggagctaaacgcctcgctgctggcgtacggaatgcctaaagaagcttgcgactggtacgctcattccctgaactataatactcctggcggtaagctgaaccggggcctctcggtcgtcgatacttacgccattctgtcgaacaagactgtcgagcagctgggccaggaggagtatgaaaaggtcgcaatccttggatggtgcattgagttgctgcaggcgtattggctggtggctgacgatatgatggacaagagtatcacccgacggggccagccttgttggtacaaggtgccggaagtcggagaaattgcgatttgggacgcttttatgcttgaggcggcgatttacaagctcctcaagtcgcacttcagaaacgagaagtactacattgatatcactgaactctttcacgaagtcacattccagaccgagctgggccagcttatggacctgatcaccgctcccgaggacaaagtcgacctttccaaattttccctcaagaaacactctttcatcgtgacctttaagacagcgtactacagcttttatctgcccgtcgctctcgccatgtacgtggcagggatcaccgacgagaaggatctcaaacaggctcgagatgtgcttatacccctgggagagtacttccagattcaggacgactacctggactgtttcggcacccctgaacagattggcaagatcggaactgacatccaggacaataaatgcagctgggtcattaataaagctttagaactggcctccgccgaacagcggaaaactctggacgagaactacggaaagaaggattccgtcgctgaagctaaatgtaagaagattttcaacgacctgaagatcgagcagctctatcacgagtacgaggagtcaattgccaaagacctcaaggcaaagatctctcaggttgacgagtcccggggttttaaggcggatgttctgaccgctttccttaataaggtatacaagaggagtaaa

SEQ ID NO: 1775 - DNA, 2757 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggcggctccatgcttcgctgttctaacacaaatgcccagttggcgaacctctccgaacaagtcaagggcaaggttacagagttcgatttcaaggagtacatgcgatctaaggctatgtctgtgaacgaggccctcgaccgagcggtgcccttgcgctaccccgagaagattcacgaggccatgcgttactccctgctggccggaggtaagagagtgcgacccatcctgtgtatcgccgcatgtgagctggtgggcgggtcagaggagttggccatgcctacagcctgcgccatggagatcattcacacaatgtctcttattcatgatgacctgccttgcatcgataatgacgacttgcggagaggcaagcctactaaccacaaggtcttcggagagggtaccgcggtcctggctggcgacgctctcttgtcgtttgctttcgaacatatagcagtgtccacaagcaagactgtggagtcggaccgcgtcctgcgagtcgtttccgagctcggtcgagcaattggttctgagggtgtcgccggtggtcaggtagcagacattacttctcagggaaacccatctgtcggcctcgagacactggaatggattcacattcataaaacagccgtcctcctggagtgctccgtcgcttccggcgccattattggtggggcttcggacgatgagattgaacgagttcgaaagtacgcccgatgtgttggactcctgtttcaggttgtcgacgacatcctggacgtgactaagagtagcgaagaacttggcaagaccgccgccaaagacttgctcagtgataaagctacttaccccaagctgatgggactcgaaaaggctaaggagtttgctgacgaactcctgggcaaggccaaggaggaattgtccttttttaaccccaccaaggcggcccccttgctcggattggctgattacatcgctcagcgccagaac

SEQ ID NO: 1776 - DNA, 2913 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggcggctccatgaaagacgtctcgctgagctcattcgatgcccacgacctcgacttagacaagttccccgaagtcgtccgagacaggctgactcagttcctcgacgcacaagagctaacaattgctgacatcggagcccctgtcactgatgctgttgcccacttgcgctctttcgtgttgaacggaggcaaacgaatcagacccctgtacgcttgggccgggttcctcgccgcgcagggacacaagaactcatccgagaagctggagtcagtgctggacgctgcggcatcgctggagttcattcaggcgtgcgccctgattcatgacgacatcatcgactcgtctgacaccagacgtggtgccccaactgttcatagggcagtggaggctgaccatagagccaacaactttgaaggagatcctgagcactttggcgtttccgtgagcatcttggccggcgatatggccttggtctgggcggaggatatgctccaggatagtggactttccgctgaggctctggcccgaacacgcgatgcctggcgaggtatgcgaaccgaggtaattggtggccagcttctcgatatctacctggagagtcatgccaacgagtccgttgagcttgctgacagcgtgaatcgctttaagacagccgcttacacaatcgcccgtcctctgcacctgggcgcctcgatcgctggtggctcccctcaactgattgacgcccttttgcactacggacacgatatcggcatcgccttccagctgcgagacgacttgctgggcgtttttggcgaccccgccattactggaaagcccgcgggcgacgatattcgtgaaggtaagcgtacagtcctgctagctctagctcttcagcgagctgacaagcagtctcctgaagctgcgaccgcaatcagggctggtgttggcaaggtcacatcccctgaagacatcgctgtgataaccgagcacatccgcgccactggtgccgaagaggaggtggaacagcggatttcacagctgacggagtccggcctcgcccaccttgacgacgttgacattccagacgaggttcgggcccagctgagagccctggcgattcgatccacagagagacgaatg

SEQ ID NO: 1777 - DNA, 2841 bp, Artificial Sequence
  source: /note="Description of Artificial Sequence: Synthetic polynucleotide"
atggcattcaacatgtcccgtttcgtgacaatgccctcccacgttttgccatcgtccttcgtggctccttcccttcaggtgtccagctcaccttgttcctggcgtacacgccctagcccatgtacctcatgccacctctccccctccagctcctccaagccactccttggctcccacgactatagcttgctgaaatctcttacactctctcctcacgctgttaactcggaagctgattcgtccacccgccgtatgaaggaagtgaaagaacgcacctgggaggccttctaccgagcctgggactcacgcgccgcaatggaaatggttgatactgtggagcgccttggcttgagctaccacttcgaggacgaaattaacgctttgctgcaacgcttctgcgactggaacgcgtctgaagatcttttcacgaccgcgctgcgcttccgcttgttgcgacagaacggttttccaacacactcggatgttttcggtaagttcatggataagaacggaaagttcaaggagtcattgaccgaagatatccgcggcatgctgtcattgcacgaagccagccacttgggagccaaaaatgaagaagttctcgcggaagccaaagagttcacccgcattcacctcattcagtcgatgccacacatggagccacatttctcctcgcatgtgggccgcgctctggagctgccacgccacttgcgcatggtacgactggaagcgcgcaactatatcggtgagtattcgcgagagagcaacccaaacctggcttttcttgaattggcgaaactggatttcgatatggttcagagcctccaccagaaagagttggcggaaatcctgcgctggtggaagcagctcggtctggtcgataagctggatttcgcacgcgatcgcccaatggaatgttttctctggaccgttggcatctttccggacccacgtcactcttcctgtcgcatcgaactgactaaggccatcgctatcctgcttgtgatcgatgatatctacgatagctatggctcattggacgaattggcactcttcaccgatgccgtcaagcgttgggatctgggcgcgatggaccagcttcccgaatacatgaaaatctgctacatggcactgtacaacacaaccaacgacattgcctaccgcattttgaaggagcacggctggtccgtaatcgagcacttgaaacgaacgtggatggacatcttcggcgcatttctcgccgaagcatactgttttaaaggcggccacgtgccatcccttgaagaatacctcaccaacgccgtaaccaccggcggtacctacatggctctggtccacgcattcttcctgatgggtcagggagtgacgcgagaaaacatggcaatgctcaagccatatccaaatattttctcatgctcaggcaagatcttgcgcctctgggatgatcttggcaccgcgcgcgaagaacaggagcgcggcgacaacgctagctcaatcgaatgttacaaacgcgaacgcgagatggacacagtccttgaggatgaggcgtgccgtaagcacattcgccagatgattcagtctctctgggtagagctcaacggtgaacttgtagcctcgtctgcgctgccactgagcatcatcaaggccgcattcaacctctcacgcaccgcgcaggtgatctaccagcacggcgatgacaacaaaacttcatccgtcgaagaccacgttcaagccctcctcttccgaccagtatcgtccaacggccatgcacagattacaatgcatggcggcggcggctccatgctcgctgaagagcagctggatccctttagcctggtcgctgacgaactctccctactggccgaccggctccgatcgatggtggtggcggaggtccccaaactcgcctcggccgccgagtacttctttaagatgggcgtggaaggtaagcgtttccgaccaacggtgctcctgctaatggccaccgccctgaacgttccccttcccagacccgctctcgcagaagttcccgaaaccctctcgaccgaactgcgaactcggcagcagtgtattgccgagatcaccgagatgatccacgtggcctccctgttgcatgatgatgtattggacgatgccgagactcggcggggcattggctctctgaacattatgatgggaaataaggtcgccgttcttgctggggattttctgctatcgcgtgcctgcgtggccctggcctcccttaagaacaccgaggtcgtgtccctgctcgccaccgttgttgagcatttggtcaccggcgagactatgcagatgacatccacttcggagcagagggtatccatggaatactatctccagaagacatactacaagacagcgtctctcatctccaactcatgtaaggctattgcccttctggccggacagacggctgaagtttctatgctggctttcgagtacggcaagaatcttggcctcgccttccagcttattgacgacgtccttgactttaccggcacgtcagcctctctgggcaaaggctccctgagcgacattcgacatggcatcatcacggcaccaattctgttcgccattgaggaatttcctcagcttgacgcggtcgtcaagcgaggactggataaccccgctgatatcgacttggctctcgactatctgggaaagtctcgtggtattcagcgaacacgagagctggcaatgaaacatgcaaacctcgccgccgaggcaattgatagcctgcccgagtcgggtgacgaggatgtactacggagccgtcgagccctcattgatcttacccacagggtcatcacccgtaccaag

SEQ ID NO: 1778 - DNA, 1173 bp, Phialophora attae
atggctggcgggaaaaaggcgctgattttcggagcttcaggcgtaaccgggtggtcgtttgtcaacgaaatcctgaacgattacccggacaagggtatctgggatcgggtgtacgcacttacaaatcgtccgctgacgcgcagtgcgagcaaatggccggatgatccaagattgcgtatagtgagcggtatcgacttgctgaagggttctcaagaggatctagagggggaactccgctcaaatgtggaagatatagaacagataacgcacgtgtactatttagcctataaagcgtcaaaagacgtagatcaagaattgaaagatgcggtggcgatgtttcaacgttcgacgatcgccctggataaacttagccccgcacttgaatttgtagtgcttcaaaccggcgctaaaatgtatggttgtcatcttctggataaccatccgaccgattatatgagcgtaccgcataaagaaagcaccccgcgcctgaaagcgccctaccacgaccaactgttttaccatcctcaactggattgggtcacggagtatgcgcgcgggaagaaatggaactggtgcgatactcgtccagatattataattggcttcgtaccgaaccagaatttctatagcttagctacgtcactggccgttttcttatccctatatcgagaggtcgaaggtgcgggtgccgaatgcatgttcccggggaccagcaaatcgtgggtggcaaaatctaatgactcatccagcgatatgattgcccgccagaccctgcatctgagcctaaccctgcccatggaccgcaaaggcgaaggttttaatgtggccgacgcacgccacccagagaccttcgaaagcaaatggccgcagatttgcgcctactttggcctgaaagggattggcccggcaaaagaacctagcaatatccgtacttatattcgcgaacattttgacacgtggcgcgccatcgaaaaaaaacatggattacagtctggcatcgcagattcagatctgacctttgaaggctttgaatatttcctgctggcgcagttcgattttgatcgtcaatacgatatgacgaagatgtatgacaccggctttacggaagaacgtacagtgatggaagcttggggaggcgtttttgatcgcatgagggcagcgaaactgatcccg

SEQ ID NO: 1779 - DNA, 1170 bp, Tarenaya spinosa
atgtgtggctggtggggcgcgggagcaattggtgcagccaaaaaaaaactggaggaagatgaaccgcccccgcgtagctatcagtcagtggggctcattattggtgtgacgggtatcgtaggcaactctctggcggagattctgccgttgtctgatacaccaggcgggccctggaaagtatacggcgttgcgcgacgtccgcagccatcgtggaacgccgatcaccctattgattacatccaatgcgacgtgtcagatacggatgatgtccgttgtaaattatcaccgcttactgatgtgacccacattttctttgttgcgtggactaaccgtggcagcgaacccgaaaactgtgaaacgaatgcgggtatgctgcgcaacgtcctgcgggcgattgtgccacacgcgccgaacttgcgccatgtatgctccgcagattggtggcgtagcattaccagcgatctccgccagccgcggcgcgtgctgccgcgctcagccattcacggtggctcaaccaaagttaccgattcagagctgcttctgcacccgggcgggtgtcctgtgcgtgggggtcgagaggagcgtcgtttagatttagtttgtaccccgaccgaacatgacctgtgggtattagcgttacagtcagatgagtatgggggatattccctgtgtatccgttcgaatctgcaggcccgcggcatcagcattgcgatccctcggaaacaagactgtgtggggcgcatccgtggcttcttcggctgtggctttgattcccgcgcggcagatctgggttcaggcgatccctacgcaggtaacgaggcgtttaactgctcgaatggtgacgttttcaaatggaaacacatgtggaaagtgttagcggaacaatttggtatcgaagagtttggcttcgaagaaggcaagaatgttggtcttggtaaaatgatggaaggcaaagaacgtgtctgggaagaaatcgtcaaagagaatcagctgaaaaaaaccaagatggaagaagtgggtgtgtggtggtttgctgacgtgatcctgggtgtggaaggcatgattgattccatgaataaaagcaaggaacacggtttccttggttttaggaactcgaagaacagttttatttcatggattgataaatataaggcttacaaaattgtgccc

SEQ ID NO: 1780 - DNA, 846 bp, Trifolium pratense
atgaagaaactcattgccaaagtgcgcaagaaagtcgctgaacacacaagtattagccttgaatcttctaaagaaaacgaaaccaccgagcccaacggcggcactgagaacaaataccccaccatggatgaaatctggtatattaacgttgtgcgtcgtggagaccagtcgcaaagcccgttcaggtcgcagagcgaaagtcagtctggcacgcagactctcttgtgcgacctcgatgaaaaaaaaccgaagaaaaaaaataaaaccagctttcatctgagccatatcattgcgtttgaactcgtttgtagtcagaccagtagtcacatatggattttgactcttcaattcgatgagtatgtagttggaaccctgtgcgtttatgcggcaatctgtaaacatggaggcgtcccactgatttttcccggcaccaaaggggcgtgggaaaactattacatggcttcggatgctgacctgatcgccgagcaacacatctgggttgccgtcgatccgtacgccaaaaatgaagcttttaactgcagcaacggcgatgtgttcatgtggaaacaactatggaaggtactggcggaacagtttgggatagaggagtatggatatgaggagggctcatcattgaaactggcggaactgatgaaagataagggaccggtgtgggatgagatagttaaagtgaatgagctgcagccgacaaaactagaagaggtgggcgagtggtggattaccgacgcgtcgttcggccttgagaatatcgtagatagcatgaacaaagccaaagaacacggtttcctcggtagcgaaattgtacgaattctgtctctcgaccgc

SEQ ID NO: 1781 - DNA, 1011 bp, Oryza glumipatula
atgctaccgatgagcatgagctggtggtgggccggcgcgatcggcgccgcgcgcaaacgccacgatggcggaggaggagagcaacaaccaccgttccgaagtgttgcactggttgtaggtagcacgggcatcgtaggtacgtccctagtcgacattctgcccttaccggatacgccgggtggtccgtggaaagtttatgcgttatcacgtcgtcctccgccgccgtggtctccgccgccgcctgcagcggttacacacctgtgcgtggatttagcggatgccgcggccgtggcagaagcgctggcgcctctaaccgacataacccacgtgttttacgttgcgctggcggcgccgcacttggcggaggcccgttctcgtgaagcgaacgcgggcatgctacgcaacgttctggcggcggtcgtcccgacttgcccggcgctagcccatgttgcgctccagacaggctctaagcactacattggcccaccggaatccattggtaagttagcggttgaaacgccattctcggaagatatgccgcgccatgattaccccaacttctattacgatcaggaagacgtgctatttgatgcggtgaccagctccagtagttcgagttctcgccgtgcggcagcggtaacgtgtagcggcttaggcaatagtggtaccgcagcgtgcggcactagtggctttggcagtagcggaactaccgggtgcggcgggtcgtcctgtttgggcaatagtggcacgacagccggatgcggaggaagctcatgccttggaaatagtggcactaccggctgcggcggcagctcatgcttaggctctagtggaacagccggctgtggcggctattcatcctctagtcatcgcgccgccttactgatggaattgcacgagagtagctcatcggcggcgcgcaaacgcactgaggaagatatggcgttcctgctggagaccatgttggtgggcgaactccacagcatcgggtgctcaacgtgcttcgacgtg

SEQ ID NO: 1782 - DNA, 1182 bp, Triticum aestivum
atgatgaaatggtggtgggcaggggcgttcggtgcctttaaaaaacgtcgggcctcgagccgcgcgcgagcggcagccgaagcgccgcagagtaacgtggcactcgtggtagggagcaccggcatcgtaggagccgcactgattgacattctgccactgcgagatacccctggcggcccgtggaaggtgtatgcattgtcccgtcgtccgcttccgccgtggtcggcgccactcccgccagacgtgttccaccaccacttggaccttgcagacccggcagcggttgctgacgccttagctcccctcacagacgtcacccacgtgttctacgttgcctgggaccctcgtccgacccatgcggagggtcgcgaagcgaacggcgcgatgctccggaatgtgctgtccgctctggtgccgaactgcccgggactgctgcacgtctgtttacagactgggcgaaagcattacgtggatccgttcgaaccgcttacggatgtaccgttagccctgcgcccgtactcagaggatttgcctcgtcttgactatcccgatttggaagatgtgttactggacggtctcgccagcaacaacagagtgacctggtccgttcatcgcccgaccacaatattcggtttctctccccgttcagcgcgcaatgtggtggccagcttatgcgtgtacgccgcgatttgcggcaaagaaggattagtccttcgatggcctgggagccgtgttgcctgggaggggttcagtgatgcgagtgacgccgaactcgtagccgagcacgcgctttgggcggcaatggaacccaacggtcgtaacgaaccatttaactgttccaatggagacttatttaaatggcagcagctgtggccgatcctggcctctcagttcggagtgaagtggacaggttaccagggcgaggatcagcgtttcatgctggaggaggccatggcaggtaaagaaggtgtctggtccgaaattgtgaatgagaacggactagtggaaaccgaactcaacgacattacgaattggttttgcgtggatgcaatggttaatgttgaacgcgaaaacctggacacgatgaataaaagcaaagaatatggtttttttggatttcgtaacaccgtgcgatcatttaatacctggattaataagatgaaagtagataaaattgtgccg

SEQ ID NO: 1783 - DNA, 1242 bp, Oryza glumipatula
atgaatgatatgtcgtggtggtgggcaggcgctatcggcggtgtccgcaaacgtcatggcgagcatgcgggggacgcctctcgcccctttcagtcagtagcactggttgtgggcagtaccgttatcgtgggaacgtcactcgttgatatcctccccttacccgatacgccgggtggcccgtggaaagtttatgctgtttcgcggcgacctttgccgccgtggagcccgccgcctagtccggcggttactcacctttgtgtggacctggccgacccagcggctgtgagcgccgccctggctccattaactgatattacacacgtgttctatgtagcgtgggcaccgcacttcgtagaagaagaccagaaccgcgaagcgaacagccggatgctgcgtaacgttcttagcgcggttgtgccgaattgtccggcgctggttcatgtgagtgttcaaaccggctccaaacattacattggtccgccggaaagcattggtaaatttacgattgagacaccgttctccgaagacatgccgcgtctggataactgcccgaacctgtactatgaccaggaagatgcgttgttcgatgcagtttctcgtagccgccgaagaggagccgcagttattagctggtcagtacatagaccttcactggtatttggcttcagcccgcgtagcgcgatgaacgtggtatgcaccctctgcgtttacgcagccatttgccgtaaagagggaggccgtaaattgcgctggccgggctcactgggcgcctgggaaggttttagtaacgcgagcgacgcggaccttgttgcggagcagcatatctgggcagcggtagacccagcggcacgcaatgaagcctataactattcgaacggagatgtctacaaatggaaacagctctggcccgtgctcgcgggtcgtttcggcatggagtggtcaggatacgaaggggaagagtcacgagtgtctcttactgaggcaatggccggtaaggaagccgcgtgggccgagattgtgcgcgaggagggtttagtggccgcagcggaactagaccaggttgcgaactggtggtttgtggatgccctcttcatggataagtgggagttcctggataccatgaacaaatcgaaggaacatggcttcttaggtttccgtaacaccgtgaaaagcttcggcacctggattgataaactgcgtttatacaagatcgtgccgtcatgtcgcattgtcagctccctt

SEQ ID NO: 1784 - DNA, 1203 bp, Madurella mycetomatis
atgccgagcgccgtagttgttggcgcgaccggtatcctgggccgagaaatcgtgaaacgattagcgcatagaccggatgaatggaaaaccgtatacgcgctgtcccgtagtaaaaaggatgagtatccgccaaatgtgacccataatcatgtggatctggtacgcagtgctgaccagatggcccagcagctgaaaggcattgaggcggaatatgtgtttttcgctgcatacctgcagaaaaacaccgaagaggaaaattggcaaattaatggggatatgctagataactttctcaaagccctagagatcaccggcgcggttaataaaatcaaacgtattcttctggtaaccggttgcaaacagtatggcgttcatctgggtcaagccaagaatccgatggttgaaaccgattcgtggctccgtgatgatccgttcccacctaatttttactacagacaacaagatattttaaaatcgttttgtgagaaacatcaagcaatctcctgggtcgtaacctaccctaacgatgtaatcggctttgcaaacggtaactttatgaacttggcagaaggcctgggcatctatgcagtcgtgagtaaagaattgggacaggatctggttttcccgggctctgaaaccttttactcgcgcttcgacagctttacctcgtcgaaactacacgcagaattctgtgaatgggcgattcgtgaaccacgtgcggcgaatcaggcttttaacgtagtgaacggtgatgtgcagacttggcaggatttatggccgcgcttggcccgccgtttcggactcaaggttaaagcagatcagttcgcaggtgatactggccttagctccaagacacgtctaggtgcccagcctcctatatcggtgttcgctgaagaagcgggcctggcaggacgtattccaccctcagaactggaacaacgtattagccttgtgaaatggagccaacaggaaaacgtgcagaaggcctggcgccggctggccgagcgggaaaaattgcaggaagacgccctggaaaaaggcacctgggcgtttattgattttgtgctgggccgcaactatgatattgtggtatcaatgtcgaaggcgcgcgaagccggctggacgggctatcaggacacttggaaatcgttgtctgatgttttcggggaactggaagcggcgtctgttctcccaaagattcac

SEQ ID NO: 1785 - DNA, 732 bp, Phaedon cochleariae
atgcagccatatacctttccggacgacttcgtgttttgcgatctggaatcgcccgatctgtcaacgtgtctacgagataagctacagaattggacgacaatgttaggtacgcggggtatcaaccaccctattcgtttcacactggaacccatggtcattgatttctgggtgctgaacatgaacctgaattttttgaatagtactgaatacctgtggaattgcacttttagccagttttggaattcgaccgtcatttctgccagctacaaccccgaaaactacacgctggtgtatacgtcatactaccctcatatcattgagcatggtcgatatcagatgtttggcaccgtatcttttgaagacggcagtgtcgacgcaatttacggaaacggtccgtacgataagcatatttacgggctgaaccttactcacaagatcacctttgtgccagtgctgcgcgaacatggcgtggaatacctacaagtgtcccgctatgaattggacagcgatggctttcgcgatacctccttgcagtggcataatttgtacaacggcgataccattcgcggtaaccgcacggtgacccgtttagcacacaacgcgatggcattaggcggtgccctggcgaaaccgttcacggacatgaccattgccatgtttcgtttatacaccgagaatttgattagcagcgtgccgagacgccagctccgccgccatttttcgcgtcatccc

SEQ ID NO: 1786 - DNA, 1116 bp, Glycine max
atgtcgaaattaaatgaagcgccgcagtcggttgcacttgtgctgggcgtaaccggcattgttggcaatagcctggcccagatcttgcctctgagtaacactcgcggtggcccgtggaaggtttacggcgtcgcacgtcggactcaaccctcgtggaacgcgttgaataccgtacattatatccagtgcgatatatcggatcagaacgatgcagaatccaagctcagcagcctcacagatgtgacccacgttttctacgtgtgttgggcgcgccgtccgaccgaagcacagaactgtcaggtgaacggagcgatgcttcgcaacgtgcttcgcgccgtaattccgaacgcccctaacctacgccatgtatcgctgcagacgggcaccaaacattatctgggtccctttgaactgctgggtaaaattgaagtggcgcacgatccgccgtttaccgaggatctgcctcgtctggatgcacccaatttctattacacgcaggaagatatcctgtttgaggaagtacgcaaaaaaggtctgacccttacctggttcgttaatcgaccgcattttatttttggtttttcgccgtatagcctgatgaacttagtgggtaccctctgtgtgtacgccgcgatctgcaagcacgaaggggtaccgttgtggtttccgggaactaaagcggtctgggaatgttacaacacggcgtcagatgcggatctgattgctgagcagcacatttggggggctgtggatccgcgtgcgaaaaatgaggcctttaactgcagtaatggcgatgtttttaagtggaaacacgtttggaaagtgttggccgagcgttttggcattagggaatacggcttcctggagggtgaagacctgcgcctgtcagaaatgatgaaagagaagggcgccgaagaaattgtgaaaaaaaacggcctgcagcggaccaaactggaagatgtgggcgattggtggttcgcggacctgatcctccgcatggaagcggttctcgatagcatgaacaaagcgcgcgaacacggtttctttggctttcgtgacagtaaaaaatcgtttatgaattggattgacaaaacaaaagcgtgtaagattgtgccg

SEQ ID NO: 1787 - DNA, 1389 bp, Triticum aestivum
atgtcgctgtcgggccacaacgatgttctgttgtgccgcgagaccgcagcgcgcagcagtccgagcgtggcggccttctcactgagtcagcaggaagggcgtacgcgctctctgctgcttccgccgaccgccggccgcagcacccaggcgcccttgacagttacggtgacggccgcaaccccgccgagcagccgtgacgaacttgtggtgggcggccgcgggcgccgtcgccaggagactcccggtcgccagcgtcgtcggtctcgcgcacgcttgctagaacggcgcccaaggcgtcgtatccacggccatcgccgtcacattgcgccgcgccatccgccggctccgcgtcaccctcgccgcgcactggagggtgtgcgcgccgtgagccgccgcgcactgccgccctggaccccgcctcccactcctgctgttactcacttacgtgttgacctcgcagatccagcggccgttgcggaggcgctcgccccgcttaccgacatcacgcatgtgttttacgcggcttggagctctcaccgcactgaagccgaaaaccgcgaagccaacgccgctatgctgcgcaatgttctgtcagtggtcgtgcccggctgcccggccttggcgcatgtgtgcctccagacgggtcgtaaacattatgtcgcgccgtttgaaagcatcggcaaaatccctggagtgccagatcccccatacaccgaagatatgccgcgcctggattgccctaacttttactatgaccaagaagatgtgttgttcgatgaagtttcacgacgcgatggtgcggtttcgtggtcagtgcatcgcccgacactaattttcggcttttctccgcgtagtgctatgaacgtggtgggaagcctgtgcgtctatgcggctatctgttgcaaggagggtgcgaccccgcgttggccggggtctcgcgtagcctgggaaggcttcaccgacgcgagtgacgcagacctcgtcgcggaacatgagatttgggcggcggtggaccctttcaccaagaacgaggcattcaattgttcaaatggcgatgtgtttaaatggaaacagctgtggccgatgctggcggatcactttggtctagaatgggcgggctacgagggggaagacggtcgatttatcattgcggatgccatggcccggaaggaagcggtgtgggccgaaatcgtgcaggaaaatgagcttgtgaccactgagctgaaagagatcactaactggtggttcgttgatgcggttttaaatttcgaagtcgaacatcttgattcaatgaataaaagcaaagaacatggttttttgggttttcgtaacacggccaacagctttaacgcttggataggaaaacttaaggccagtaagattgtccca

SEQ ID NO: 1788 - DNA, 1167 bp, Olea europaea
atgtcctggtggtcgacccgcgccattggggcggcaaaaaaaaagttcgaggaagatgaggcgccgattaaacatcaatccgtcgcacttgtcattggcgtgactggtattgtaggcaattcgcttgcggaaattctgcctttggcggataccccgggcggcccctggaaggtctatggcgtggcacgacgcccccagccgtcgtggagcgaggacaatccgattcagtacattcgctgcgatatatcggatcacgaagatgcgcaagccaaactgtctcctcttaccgacgtgacgcatatcttctatgtgacctggaccaataaatctacggaagctgaaaactgcgaagcgaacggtaaaatgtttaaaaacgtcctggaggccgtcataagcaattgtccgaaccttaagcacatctgcctgcaaactggccgtaagcattacgtcggcccttttgagtcattcggtaagattaaatttcatgataccccgttccacgaggatctgccgcgcctggactgcccaaacttttactacaccatggaggatattttgtttgaagaagtggaaaaacgcgagggcttaacctggtctatccaccgccccggcctcatcttcggtttcagtcctttttccatgatgaatttggtgggcaccctgtgtgtgtatgctgcaatttgtaaacatgaaggaatgccacttcgttttcccggctctgaggtagtgtgggatggatattatgattgtagcgacgccgacctgattgccgaacaccagatttgggccgccgtcgatccatatgcgcgcaacgaagcctttaacattagcaacggtgatgttttcaaatggaaacatttctggcgcattttagcggaacagttcggggtggaatatgaagaatttgaagaaggtcagaacttaacgctgctcgcgatgatgaaagataagggtaaagtctgggatgaaattgtgcgtgaaaacggcctgactccgacaaaactggaggatgtgggggtctggtggcttgccgataccatgctgagtttaaaatgtcttctggatactatgaacaaatcaaaagaacacggttttctggggttccgcaacagcaaaaattcatttattagctggattgataaactgaaggcgtataaaatcgtgcct

SEQ ID NO: 1789 - DNA, 1170 bp, Camptotheca acuminata
atgtcgtggtggtgggcgggtgcgatcggcgcagcgaaaaaaaaatttgaggaagacggcggtccgaaggtctttcagagtgtaggtttaatcgtcggcgtaacaggtattgtgggaaattccctcgcggaaatactgccgctgagcgatacccccggagggccgtggaaagtttacggcgttgcccgccgcacgcgcccgccctggaatgttgatcaccctgtggagtacattcagtgcgacatcagcgacgcggatgacgccctcgccaaactaagtccattaaccgacctgacccatattttctacgtgacttgggcgaaccgttcgaccgaactcgaaaactgtgaatcgaacgggacgatgctccgcaacgtactgcgtgctgtaattcctaatgcgcctaatctgagccatatctgtcttcagacaggcaccaaacattacattggtccgttcgaatcctttggtaaggtacaaccacacgaaccgccgtttactgaagatatgcctcgccttgacgccccgaatttttattatacattggaagatgtgttgttcgaggaagctgcgaaaaaggaaggtctgacctggactattcatcgtccgcaggttattttcggctttagcccgtacagcatgatgaacattattggcaccttatgcgtgtacgcggccatctgtaaacacgaaaacactccgctcaaattccctggaagcaagacggcgtggaactgttattctaatgcctcggatgcggatctcattgcggaacatcaaatctgggctgtggtggatccttatgcaaagaatgaagcgtttaattgcagcaacggcgatgtgtttaaatggaaacacctgtggaaggttctggcggaacagttcgatgtcgactatgtggagtgcgatgaatcagaaaaacctgttagcttagaggaaatgatgaaggaaaagggtccggtttgggatgaaatcgttaaagaacgagaattggtgccgaccaaacttgaagaagtcggtatgtggtggtttgttgatgtgatctttgctggtgaagccatgctggatagcatgaataaatcgaaagaacatggttttagcggttttcgtaattcgaaaaatagtttcatctcgtggatcgataaggtcaaagattataagattgtgcct

SEQ ID NO: 1790 - DNA, 1041 bp, Musa acuminata
atgagctggtggtgggcgggcgccattggtgcggcgaaaaaaaaaaccacgggcgatgatgcagacgcaccggccgcccgctaccagtctgtggcgctggttgttggtgcgaccggcatcgtaggctcgagtctgtacgacattttgccattagcggatacccccggcggaccgtggaaactgtctcctctgggtgatgtgactcacattttctatgcggcctggtgccgtcgctctaccgcggccgaaactcgcgcaaccaatgccgcgatgctgcgcaacgtgttagatgcagttctgcctgcggcgccgaatctccagcatgtgtgcctgcagacaggtcgtaatcactatctgggcccttacggcccggcaggtggggtagtggcggaagtgggaccgcgccatgatcccccgcatgacccgccttttccggaaaacaccccgcgcttagcgattccgaacttctactatgaactggaagatgtacttctggaagaattggcaaaaaaagaacgcgcagtgacctggagcgtgcatcgcccgacaacaatttttggctttagcccgtgttccctgatgaatctggtgtgcagcctgtgcgtttacgcgtcgatatgtcgtaaggaaggtgttccgctgcggtggtttggtagcgaggaggcgtggtatggctttagcgatgccagtgatgccgacttagtggccgagcaccagatctgggcagcggtggatccgtatgcaaaaaatgaagcgtttaattgtagtaacggtgatgtgttcaaatggaaacatctgtggcctgacgccatgaagggcaaggaggctgtgtgggaagacattgtgcgcgaaaatgaactggttcccacggctttagatgaagtgggtcattggtggtacgcagatgcggttctgggcttggaattcgagcatttagacaatatgaataaatcgaaagaacatggtttcctaggttttcgcaatagcgtgacctcatttaatacctggatcgacaaactccgcgcgtacaaagttgttcca

SEQ ID NO: 1791 - DNA, 1161 bp, Arabidopsis thaliana
atgagctggtggtgggcgggcgccattggcgccgccaaaaaactggatgaagacgagccctcgcaaagcttcgaatccgtagcactgatcattggtgtaacaggtatcgtgggcaatagcttggccgagattctgccgctgtctgacacgccaggtggtccctggaaagtctatggagttgcccgccgtccgcgtcctacctggaacgcggatcacccgattgattacattcaatgcgatgtgtcagatgctgaagacacccgctccaaactgtcgccgctgactgacgttacccatgtgttttatgtgacctggacgaatcgtgaaagcgaatctgaaaattgtgaagcgaatggcagcatgttgcgtaatgttcttcaggccatcattccttatgcaccgaatttacgacatgtttgcttgcagacgggcacaaaacactatctgggtccctttaccaacgtcgatggacctagacacgatcctccgttcacggaagatatgccacgtctgcagatacagaacttctactacactcaggaggatattcttttcgaggagatcaagaagattgaaactgttacctggtcaattcaccgcccgaacatgatttttgggttttctccgtattcgctgatgaacatcgtaggaacgttgtgcgtgtacgctgcgatctgtaaacatgagggcagcccattactgtttccagggtccaaaaaagcatgggaaggtttcatgaccgcaagcgacgccgatctcattgccgaacagcaaatttgggcagccgtggacccctacgcgaaaaatgaagcgttcaattgcaacaatgctgatatcttcaaatggaaacacctttggaagattctggccgaacagttcggcattgaggaatatggtttcgaagagggcaaaaaccttggactggtggaaatgatgaaaggcaaagagcgtgtctgggaagaaatggtaaaagaaaaccaattacaggaaaagaaattggaagaggttggagtgtggtggtttgcggatgtgattctgggcgtcgagggaatgattgatagcatgaacaaaagcaaggaatatgggttcctcggctttcgcaattcaaataacagttttatctcgtggatcgataagtacaaggcctttaaaattgtgcca

SEQ ID NO: 1792 - DNA, 1167 bp, Digitalis lanata
atgtcttggtggtgggcgggtgccattggcgccgccaaaaaacgcctggaggaagatgatgcccagcccaaacatagcagtgttgcgcttattgtgggcgtgaccgggatcatcggtaactccctggccgaaatcctgcctctcgccgatacgccagggggtccgtggaaggtatatggagtggcgcgccgtacacgacctgcatggcatgaagataacccgataaactacgttcagtgtgatatctcggatcctgatgatagccaggccaaactgagccctctgacagacgttacccatgtcttctacgtcacctgggcgaataggagcaccgaacaggagaactgcgaagccaactcaaaaatgttccgtaatgtgctggatgctgttatcccgaactgcccgaatctaaaacacatttcattgcagacgggtcgtaaacattatatgggcccgtttgaaagctacggcaaaattgaaagtcacgatccgccatacacggaggatctgccacgcctgaaatacatgaacttttattacgatctggaagatatcatgctggaagaagttgagaaaaaggaaggtttgacgtggtctgtccaccgccctggcaacatctttggttttagcccttacagcatgatgaacttggtgggcaccctgtgcgtttatgcggccatctgcaaacacgaaggtaaagttctgcgcttcactggatgcaaggcggcgtgggatggctatagcgactgttctgacgcggatttgattgccgagcatcacatttgggcagcagttgatccctatgccaaaaatgaagcgttcaatgtcagcaatggtgacgtctttaaatggaaacacttttggaaagtattagccgaacagttcggcgtgggttgcggtgaatacgaagagggcgtcgatcttaaactgcaagatctgatgaaaggtaaagaaccggtctgggaagaaatcgttcgtgaaaatggcttaactccaacgaaactcaaagatgtgggcatttggtggtttggtgacgtaattcttggtaacgaatgctttttagatagtatgaacaaaagtaaagaacatggcttcctcggctttcgtaatagcaaaaatgccttcatcagctggatagataaggcaaaagcctacaaaatcgtgcca

SEQ ID NO: 1793 - DNA, 789 bp, Musa acuminata
atgtcctggtggtgggccggtgcgattggcgccgcgcgtaaaaaactggacgatgatttctccgcggcagcgccccgtcatcagtcagttgcgctggtcatcggtgcgacgggcatcgtcggcagctcattaattggaattctgcctctcccggatactcctgggggcccatggaaagtgtatggtgtctcgcgccgctccccgaacccgaacctgagtcccctgagcgatgtgacccataccgggcgcaaacactatatcggcccatttgaatcgattggcaagatcagcgctcatgatccgccatttcacgaagacttgccgcgcctgaacgtgccgaatttttactacgatcaggaggatattctctttgatgaattatccaaacgcgacggcgcggtgacgtggagcattcatcgcccgggaaccatctttggatttagtccgaccagtctgatgaatattattggcaccctgtgcgtgtatgccgcgatttgtcgtaaagaaggcgcgccacttaaatggtttggttcccgtacggcctgggacggcttctctgatgcttcggacgcggatttgattgccgaacatcagatctgggctgcagtcgatccgtatgcgaagaacgaggcattcaattgttcgaatggcgatggtgaggaaggtcgttttaaactagaagacgctatgcgcgaaaaagacaaagaacatggtttcctgggatttcgcaatacgttgacctcattcaattcctggattgataaaatgaaggcgttccggattgttcct

SEQ ID NO: 1794 - DNA, 1038 bp, Musa acuminata
atgtcttggtggtgggccggtgcgatcggtgcggcacgcaaaaagcttgaggatgatagcagtagcaccgtccccaaatatgaaagtgtggccattgtgattggtgcgaccggcatcgttggcaccagtcttgttgatatcttaccgctggcggatacaccaggcgggccttggaaagtatacgccgctccggtagccgcagacacacttcgtgttcagcacattcaatgtgatgttctggatgctgcggacgcagttgcgaaactgagccctcttacggatgtgacccatcttttttacgtggcatgggcgaatcgcctgaccgaggctgagaaccgtgtggtgaacagcgccatgctgcgtaatgttttatcggcggtagtgcccagcgcgcctaatttatgccatgtgtgcctgcagacaggccgcaagcattatgtgggtccgttcgaggcggtcggcaaggcgctggcccacgaccctccgttccgcgaagacctgccacgtctgcctgttccaaacttttactatgaccaggaggatattctgttcgatgaactgagcaagaaagagggtgcggtgacctggtcgattcatcgccccaccacgatctttggattttcgccaacgtcactgatgaatctgatcggcaccctctgcgtgtatgcagccatctgccgcaaagaaggtgcgccgctgaaatggttcggcagtcgtacgacctgggacgggttcaacgatgcctctgacgcggacttaattgctgagcaacagatttgggcggctgttgatccgtatgccaaaaacgaagcctttaatatatcgaacggcgacttattcaagtggaaacacctgtgggcggcgttggctgatcagtttggtttggagagtgtcggttacgagggtgaagcttcacgcttcaagctagaggacgccatgcgtggcaaagaggccgaacatggctttctgggcttccgtaataccgtagcatcttttaactcctgcatcgataaaatgaaagcctttaaaattgtgccg

SEQ ID NO: 1795 - DNA, 1188 bp, Anthurium amnicola
atgtcatggtggtgggcgggcgcgataggcgcggcacgtaaaaagctagaggaagaagaagataccggcggcggtcctcgccgttaccagtccgttggcctggtagtgggcgttaccggcatcgtcgggaatagcctggcagaaattctgccgctatctgacactcccggaggcccgtggaaagtgtacggagtcgcccgccgcccgcgccctgcctggaacctcgcggaccatccggtcgagtatatccagtgtgacgtttctgatgcagatgatgcccgcgccaaactgagcccccttaccgatgtaacccatctgttttatgttacttggagctcgcgtccgacagaagcagagaactgtgaagttaatgcgcgcatgctacgtaatgtgctggccaccttgattccagtgtgcccaggcctgcgtcatgtttgcctgcaaaccggccgcaaacattacatcggccctttcgaacttgtgggtaaaataccaaccgcagacccgccttatcacgaggatctgccgcggctggagtgtccgaacttttaccatgatcttgaagacgtactgttcgaaacagcagctaaggctggaagcttaacgtggagcgttcaccggcctggcttcatttttggcttcagcccgtattccatcatgaacgtaatgggctcattgtgtgtttatgccgccatttgtaagcatgaaggcattcccttgcgttatccaggcaatcgtgtggtttgggagggttattcaaacgcaagtgacgctgaccttattgcggaacatcagatttgggcagcagtggacccgtacgccaagaatgaagcgtttaactgctcaaatggtgatgtgttcaagtggaaacatctgtggagagttctcgctgaacagtttggtctggattatgtgggttatgaaggggaagagggccgcttcggagtggcggaagcgatggctggtaaaggccctgtctgggatgcgatcgtgaaagaaaacgaattaagccagacccgcctggaagaagtggctcagtggtggttcgtcgatctgctcgtcaactgcgaagatacccatcttgatagtatgaacaagagcaaggaacatggctttttaggtttccgtaactcagtgaatagtttcatttattggattgataagatgaaagcctacaaaatcgtgcca

SEQ ID NO: 1796 - DNA, 1179 bp, Cinchona ledgeriana
atgtcatggtggtgggccggtgctgtgggtgcggctcgtaaaaccctcggtcaggatggtgccccgcgctcaaaaaactttcagtcggttgcgctgattataggcgtaaccggaattgtcgggggctcgttagctgagattttgcccctgtcggatacaccggggggtccgtggaaagtctatggcgttgcgcgccgcccacgaccgagctggaatctcgatcatccggtagagtacatccagtgtgatgtattggatgcaggggatacccgtgcgaaattgagccccctgtcagatattacccatatcttctgggtcacttgggccaacaggccttccgaagcagaatgcattaaagttaatggcgctatgttccagaatgtgttgaattccgtcgtacctaacgccccaaatctaagccacatttgcttgcagaccggccataaacactatattggcccgtttgaagcattcggaaagatcaaaccccatgaaactccgtttattgaagatgttccgcgtctcaatgccccgaacttctactataccttagaggacatgctgtttgatgcctgtaataaatcgaaaggcctgctgacgtggtctgttcatcgtgcggcggtaattttcggcttttctccgtgtagcatgatgaacctggtagggagcctgtgcgtctacgccgccatctgtaaagacgaaaacgtgcctctcaaattccctggaacgaaagcagcctggaactgctacagtgttgcatcggacgctgacctgattgcggaacatcaaatttggagtgccgtggatccgtacgccaaaaatgaagccttcaattgctcaaatggcgatgtattcaaatggaaacatctgtggaaggtcctggctgaacagtttgaagtcgaatacgcagagtttgacgagaacgaaaagtttgtctcactggcggaaaggatgaagaataaaggcccggtgtgggacgaaattgtcaaaaagaatcaactaactcccaccaaattagaagaggttgcgactttctggtttgcggatgtcattttcagcggggaatgcctgctagattccatgaataaaagcaaggagcatggtttcttaggattccgtaacacgtccaaatccctgatatcggttatcgataagatgaaagcgtacaaaattgtcccg

SEQ ID NO: 1797 - DNA, 1287 bp, Triticum aestivum
atgagctggtggtgggcgggtgcagttggcgccgttaaaaaacgccaggatgaacgggcggcggccgcggaaccgacctttcaatcggtagccctgattctggggagtaccggtattgtaggaaccagtttactggatatcctgccacgcgacgatacgccgggtggcccctggaaagtgtacgcggtctctcgccgtgcgccgccgggatggtcgaccccgccgccctccccagccgtaactcatctgcaactggacctagcggatccggcagccgtgcgagatgctttgactccgctgacggatgttacccatgtgttttatgctgcgtggtccagccatgaaaccgaagaccgtaaccgcgaggttaatgcgggcatgctgcgcaatgtgctgtcggtggtggtgccgggctgtccggccttagcgcacgtgtgtcttcaaacgggccggaaacactatgttggcccgtttgatgtaatcggtaaaattcctgccccggacccgccttatacggaagatatgccgcgtttagaccatccgaacttctattacgacctggaagatgttttattcgatcatgtttcgggccgtgatggtgccgtaacgtggagcgtgcatcgtccgaccgttattttcggttttagcccgcggtcggccatgaacgttgtagggtcactgtgtgtatatgcagcgatttgccgtaaagaaggcgccacgctgcgctggccgggctgcaaagtagcctgggaaggcttcacagatgcaagcgacgctgatctggtagccgaacacgaaatctgggcggctgtggacccgtttgccaaaaacgaggcgtttaattgcagtaacggtgatgtctttaaatggaaacagctgtggccgctgttggcggaccgtttcggcgtggaatgggccggctacgaaggcgaggattctcgctttgccttagcagatgcaatggcgggtaaggaagcggtgtggaccgaaattattcaagagaacgaacttgtaacgaccgagctggaggaaattacttcctggtggtttgtggatgccatgttgtccatcgacattgaacatttagacaacatgaacaaatcgaaggaacatgggtttctggggtttaggaatacaattaacagttttaatgcatggattgataaaatgaaggcatcaaaatgttatgctagcgtgtttaaaacggaaatcgtgtcttttaagacccgacgcacgaaagcaaagtacagccaagaagtgaatgcgcagaaacagcagaccctattg

SEQ ID NO: 1798 - DNA, 1023 bp, Aegilops tauschii
atgagctggtggtgggcgggtgcggtcggcgcagttaagaaatcgcaggaggaacgcaccgagccgtctttccagtcggtggcccttgtcgtggggtcaacgggcatagtggggacgagcttggtcgatatactgccgcgccatgatacccctggcggtccttggaaagcgcacccaacggaagctcagaaccgggaagcgaacagtgccatgctgcgcaacgtgctctctgtagtggtgccgggttgtccggcccttgcgcacgtttgtctgcagaccggacgtaaacactacatcggtccctatgaggctattggaaaaattcccgtaccggatccgccttatacggaagatatgccgcgcctggattacccgaatttttattatgatcaagaagatgttctgttcgaagaagtttcacgccgggatggtgcggtgtcttggagcgtgcaccgcccatccgtcgtgtttggctttagcccgcgttcagccatgaacgtggtagcgtctctgtgcgtgtatgcggcgatttgccgtaaagaaggtgccatgcttcgctggccgggtagccgcgtggcctgggagggattcagcgatgcgagcgatgccgacctggtggcggagcaggagatctgggccgccgttgatccgttagcaaagaatgaagcatttaactgctccaacggtgatctttataaatggaagcagctttggcccatggtggctgatcggtttggcgtagaatgggcggggtacgaaggcgaagaaagccgtttcatgctggctgatgccatggccggaaaggaggcggtgtgggcggaaattttgcaggaaaatgaactggttacgactgagctgcaagaaatagcgaactggtggtttttagatgcggtgtttaacgtgaaatgtgagcacctggactccatgaataaaagcaaagaacacggtttcctgggattccgcaacaccgcgaaaagttttaacgcctggattgataaaatgaaggtgctcaagatcgttccg

SEQ ID NO: 1799 - DNA, 1173 bp, Vinca minor
atgtcctggtggtgggctggtgcggtttcggcagcgcgcaaaattagcgatgaaaattacgaagcgccgaaaaaattccaaagcgtcgcactcattatcggcgttacgggcattgtaggcaacagcttggccgaaattttaccgctgtcggatacgcctggcggtccctggaaagtttacggagtggcgcgccgtcctcgtccagcatggaactcggaccatccggttgaatacatacaatgtgatgtttatagctcagaagaaacacagagcaaactgagccctctgacagatgttacccatatcttctggactacctgggcgaatcgtccgaccgaggcccagtgcattgaagtgaatggcagcatgtttcagaacgtaattgatgcactcctcccgaatgcaccgaacctgtcacacatttgtattcaaaccggtcacaagcactacattggtccgttcgaatctttcggaaaaatcaaaccgcatgacacgccgttcattgaggacgtccctcgtctggatgtaccgaatttttaccacaccctggaagatattgcgttcgacgcgtgcaataaaaaggaaggcctgacgtggagtgtgcatcgcccggcggtgattttcgggttctccccgaattctatgatgaatttaatcggtactctttgcgtgtatgcgactatttgcaaacacgaaaatgtcccgttgacttacccgggtacaaaagcggcgtggaattgctatagtgttgccagtgatgcggatctgattgccgagcatcagatttgggcggcggtggacccgtacgcaaagaatgaagcgtttaactgtagcaacggagatatttttaagtggaaacacctttggaaagtgttgtctgagcagttcgaagtggagtttgtcgagtttgacgaaaaccaggagtacgtaagtttaagtgagcgcatgaaaggcaaaggtcaggtatgggacgaaattgtgaagaaaaatcaacttttgccgaccaagctcgaggaagtcgccactttttggttcgctgatgtcattttaggctttgaatgtctgctggatagtatgaacaaatctaaggaacacggttttttaggttttcgcaacacagagaaaagtctgatctctgttgttgacaaaatgaaggcccacaaaatcgtacct

SEQ ID NO: 1800 - DNA, 1173 bp, Cinchona pubescens
atgagctggtggtggaaacgcagtattgacgccggcaaaaatagtggaaaaaaattggaggtcaatgaaaacgaagcaattgtcgaggattataaatctgtggcgcttgtggtcggagtcaccggtattgtaggcagttcactggctcaggtgctcgcgcttccgggcacgccagggggcccgtggaaggtgtacggcgttgcacgtcggagccgtcctgtgtggttcagtaaaaaccacctggaatatatccagtgtgatgtgtcgaatacccaagaaaccatcagcaaactgtcgcccctgaccgatattactcatatcttctatgtctcatggataggcagcgaggattgtgatatcaatgccactatgtttaagaatatcctgaacacggtgattccaaacgccccgaaactgcaacacatttgcctgcagaccggcattaaacattattttggtattttcgaggaaggttcgaaggtggaaccgcacgactccccttttaccgaagacttgccgcgtctggatgtgccgaacttttaccacgatctggaggatatcctgtatgaagaaacgtcgaaaaacaatttgacttggagcgttcatcgtccggcactggtgtttggctttagtccttgcagcctgatgaacattgcatctaccttgtgcgtgtatgcgactatttgcaaatatgagaataaaccgctagtctatacaggcagcaaagcgagctggaactgctattctgatgccgtggatgccgatctcattgcggagcaccagatttgggccgcagtcgacccgaaggcaaaaaaccaggttcttaattgcaacaatggggacgtgtttaaatggaaacatgtgtggaaaacgttagcagaacagtttgggttggagatggtgggctatatcgaaggaaagcagcaggtctccctagcggagctaatgaaggacaaggatcttgtatgggacgaaatcgtgaaaaaacacaacctggctccaaccaaattgaaagacatcgcggccttttggttcgcggatatcgcgttttgttctgaaaacttcctgtcaagcatgaataaaaacaaagaattaggctttttgggttttcgtgactcaattaaatcctttaacagctgcatcgacaaaatgcgcgcttatcgcttcattcct

SEQ ID NO: 1801 - DNA, 1179 bp, Ophiorrhiza pumila
atgtcttggtggtggaagcgtagcattggcgaaggtcagaattccgcaaaaacctccgaagagattaacggtttaaatggcgaggatgaccaagactacaaaagcgtgggcttggtcgtgggcgtgacgggtattgtgggctcatcactggcgcaagttctcactttgagtgataccccgaatggcccgtggaaagtgtatggcgttgcccgtcgccgtcgcccggattggttctcgaaacagcatttacactacattcagtgtgacgtttccaatacacaagaaacgatatcgaaattaagccccctgacggacatcacccacattttctacgtgagctgggtgggcagcgaagattgcgacacgaacgcaacgatgtttaagaacattgttaacatcgtgatcccgaacgcgccgaatctcaaacacatttctctacagactggttcgaaacactattttggcattttcgaggaaggctcgaaagttaaacctaacgagagcccgtttaaggaagatatgccacgcttggatgtgaaaaacttttatcacgacctggaggatatcttatacgaagaaacttcgaaaaacggcttaacctggagcgtacatcgcccggcgctggtttacgggttcagcccctgtagcatgatgaatatcgtatcaacgctgtcagtctacgccacaatttgcaaacacgaaaaccgtcctctaacgtatcctggaagcaaagcgtcatggaactgctatgtggattgtgtggacgcggatctgatcgcggagcatcatatttgggcggcggtggatccgaaagccaaaaatcagattcttaattgcacgaacggtgacgtgttcaaatggaaacatatttggaaagcgctggcggaggaattcggcctggaaatggtcggatacatcgaaggtaaagagcaggtgagcatggcggagctgatgaaggataaggaccttgtgtgggatgaaattgtgaaaaaaaataacctggtgccgaccaaactgaacgacatcgcggcgttctggttcgcagacatcgcattttcatgcgtcgacctgctgtcaagtatgaccaaaagcaaagaactgggcttcctgggctttcgcgataccatgaaatctttctccagttgtatcgacaaaatgcgagcgtaccgtttcatcccg

SEQ ID NO: 1802 - DNA, 1170 bp, Swertia japonica
atgtcttggtggtggaaacgctccgtccaggcacagaacctcccggagaagaatcagcctaacggcgtagctgagactgcaggtcgctatgaaagcgttgcgctcgtggtcggtgtgacaggcattgtgggcagctcacttgcgcaggtgctgaaactcccagataccccaggtggcccgtggaaggtgtatggcgtcgcgagacgtccgtgcccggcttggctcgcgaaattccatgttgaatatatccaatgcgatgtctccaataccgaagaagccaaaacaaagcttagcccgctgaaagatgtgacccacattttttatgtgagctggattggttcagaagattgcgagaccaacgcagtcatgttcaaaaatatcctgtacaacattattcccgtggcacctaatctgaaacacatctcccttcagaccgggagcaagcactatttcggtattttcgaggaaggtagcgaggacgtccctcacgaatccccgtacaccgaagatttacctcgtctcaatatcccaaacttttatcatgatcttgaggatattctgtttgaggaaacggccaaacacggactgacctggtgcgtacagcggccggcgcttatcttcggcttctctccgtgctcattaatgaatattgtttcgaccctgtccatctatgcgaccatctgtaaacacgaaaacaaacccctggtttaccccggatcgaaagcgtcatggaactgctacgttgacggtgcagatgcagatctggccgcagaacatcacatttgggccgccgttgaccccaaagcccgtaaccaggtgttcaatgtgaaaaatggagatgtctttaaatggaaaaacgtttggaaaatgctggctgatgagtttgaaatcgaaatggttggctatatcgaagggaacgaacaggtgagcatggctgaattaatgaaagacaaggacggcgtttgggatgaaattgtgaaaaaacataagttggaagatacgaaattaaaagaaattgccgcattctggttcgcggatattgcgttctcttgtgttgatctggtgatgagtgttacaaaaagccgagaattcggctttttaggttttcgcgatagtatgaagtcattcaagagctgcatccacaaaatgcgtgattttaagtttattccg

SEQ ID NO: 1803 - DNA, 1173 bp, Lonicera japonica
atgtcttggtggtggtctggcgcgattggtgccgccaaaaaaaaatttgatgatgacgatgcgccgaaaggattccagagtgtcgcgctggtgatcggaattacgggtattgtaggaaacagtttagcggaaatcttgccgttaagtgataccccgggcggcccctggaaagtgtacggcgtggcacgtcgcccgcgtccgtcgtggaatgcggatcatccggtggaatatattcaatgcgacatttctgatactgaacagacattgaccaaactgtctccgctgactgacgttacccatattttttggaacacttgggcgaatgggggtgcggaggccgtgtgttgcgaaattaatggcaccatgctaaaaaacgttctggccgccgccatcccgaacgcaccgaacttacgccacatatgcctgcagactggccataaacactatatcggcccgttcgagtcattcgggaaaattactcctcacgacacaccgttcgtagaagatgtcccgcgtctgaatgttaccaacttctattacaccctggaagatattaccgcggaagcagcggcacgcaagaatggcgccttaacgtggtcagtccatcgtcccgcggtcatctttggttttagcccgtactcaatgatgaacctggtaggcaccatatgtgtctatgcggcgatttgcaaacacgagaaggcgcctttcaaattccctggcacgaaagcggcatgggactgctattcagttgcaagcgatgcggatctcattgcggagcatcagatttgggcagccgttgatccgaacgccaaaaacgaaggttttaactgctctaacggtgatctctttaaatggaaacacctgtggaaagtgctggcggaacagtttgaggtggagtacgttgaattcgatgaaaatgaagccgccgtttcactctcggaacgcatgaaagaaaaagggccggtgtgggaggatatggttaaagaaaatggtctgaccccgaccaaactggaagaggtggcatccttttggtttgcggatgttattttctctggcgaatgcatgttggactcaatgaacaaatcgaaagagcatggctttctggggtttcgcaataccaagaatagcctgattaatgttatcgataaaatgaaggcgtacaaaattgttccc

SEQ ID NO: 1804 - DNA, 1164 bp, Rauwolfia serpentina
atgtcctggtggtggacccgtagtattggcgccggcaaaaatctccgcgagcagaataaagagaatggcgtcagcgagtcctataaatccgtggcccttgttgtgggcgtaacgggcatcgtaggctcatcactggcggaagtgctgaaactgccggataccccgggcggtgcttggaaagtctatggagtagcacgccgtccgtgcccggcgtggttagctaaaaagcagattgaatatgtgcaatgcgatgtcagcaacaccgaggaaacgactgcgaagctgtcgccgctgaaagatctgacccatattttttacgtctcctggatcggcagcgaggattgtcaaattaacgcaacgatgctacggaatattctggacgcggtaattccgaatgcacaaaacctgcagcatgtgtgcctgcagacaggcatcaagcactacttcggcatcttcgaggaaggttcagaagtggaaccgcatgatagcccgtttaccgaagacctgccacgcctcaacgtacctaacttttatcatgatctcgaagatattctgtatgaagaaactgcgaagaataacctgacatggtctgttcaccgcccggccttagtcttcggtttctcaccctgctcaatgatgaatatagcaagtaccctaagcgtctatgcgacgatctgcaagcacgagaataaacccctggtgtacccgggtagtaagaaatcttggaactgcagtgcggatgccgtagacgcggacctggtggcggagcaggaaatctgggcggccgtcgaccctaaggcaaaaaatcaggtactcaactgcaataatggcgatgtgttcaagtggaaacacatttggaagaccctggcagaacagttcgggctggaaatggttggttatgtggagggcaaagaacaggtgtcgctggcagaactgatgaaggacaaagatagtgtgtgggatgaaatcgttaaaaaacataatctggtaccggcccgtttgaaagatatcgcagcgttctggtttgcggacattgcgtttagttcagagaacctactctcgagtgtgaacaagtcaaaagaacacggctttttaggcttccggaacagcatgaagtctttcgtgtcatgtatcgacaaaatgcgcgattataaattcattccg

SEQ ID NO: 1805 - DNA, 1218 bp, Lonicera japonica
atgtcttggtggtggacacgcagcattggtggggaaaaaggctcgtcatacggcaaaattgctgaacagaacggagtgcaggccaatgggaattctcatttacataaaaaggaggaaaatgggggtccggccacgtataaaagcgtggcgttgatagtaggcgtaaccggcattgtagggtcgagcttagcagagattttgccgttgcagaacactccgggcggtccgtggaaagtatacggcgtggcgaggcgtccgcgtccgtcttggacagataaaagccctattaattatattcaatgcgatgtctcgaacacaattgagaccgtggcgaagcttagcccgctgaccgatattacccatattttctacgtgagctggatgggttcagaagactgtgaaattaatgccattatgttccaaaacattctagatgccgttatcccgaacgccccgaacttaaaacacatctcgctgcaaacggggattaaacactatatgggggtgtttgaaactgatactaaacagaaaccgcacgactcaccgtatactgaggacctgccgcgtcttaacgttcagaacttttaccataacctggaagacattctttatgaagagacggccaaaaaaggtctgacctggtctgtgcatcgcccggcgttagtattcggctttagcccatgctcgatgatgaatatcgtctcaaccctttccgtgtatgcagcgatttgcaaacatgagaacaagccactcgtgtaccctggctcgaagggctcttgggattgttacgcggatgctgtagacgccgatctgatcgcggagcatcatatatgggctgcggtggatccgaaagcaaagaatgaaatctttaactgcaataacggcgacgtgtttaaatggaaacatatttggaaagctctggccgaaaagttcgagcttgaaatggtgggctacgaagaaggaaaagagcaggtgagcatggcagagatgatgaaagataaggaggaagtgtgggatgaaattgtacgtgaaaacaagcttgtaccgacaaaacttaaggacattgcggcctggtggtttgcggatatcgcctttgtcacgcaaaacgtactctcctctatgaacaagaacaaagaacatggatttgaaggcttccgcaattccaccaaatcgtttgtttcttgcattgataaaatgaaagcctatcgcattatcccc

SEQ ID NO: 1806 - DNA, 1242 bp, Oryza sativa
atggtctcatcggcactgcctcgcggggaaccggtgacacacatttgtgtggacctggcagatccggcggcagtttcggcggccttggcccccttgacagatatcacccatgtgttctatgttgcctgggcgcctcattttttcgaagaggatcagaaccgtgaagcgaactcccgtatgctgcgcaatgtcctgagcgcagttgtacccaattgcccggcactcgtacacgtgtcgcttcagacgggttcaaaacattatatcggcccgccggagagcatcggtaagttcacgatagaaactccattcagtgaggatatgccgcggctggataattgccctaacctgtattacgatcaggaagatgcgcttttcgatgccgtatctcgtagccgtcgccgcggcgccgcggtgattagctggtcagttcatcgccctttcccgcgtgttcgactcttgccggcggaacggcacgaaagaggtgtacatccgttacgagttaggggacatctgccacagggtggccgtcaagaagcgcctgttgcgggcgtcgcacgtcgcgtaggtcgtgtacagcagcgcgttcgccgcggtccgcgtcgtggcgcagcgcatctgggaggccggcgaccaggtggcgaggaacgtggtgtgcagctgcagcagagacgtcggttacaggtcgaagccgcagtcgacggtgcccgtcggcaagtccgcgacggagtggtgggagttcggggtggcggagaacagggtgaaccggatggcggcggcatcgtgcgggaggaagggttagtagcggccgcggaattagaccaggtggcaaactggtggtttgtcgatgcgctcttcatggataaatgggagtttctggacactatgaacaaaagcaaagaacacggctttctgggattccgtaataccgtgaaaagctttggcacctggatcgacaaactgcgcctgtataaaattgtaccgtcatgtcgtatcggtgaaccggacggcgggggtatcgtacgtgaagaaggcctggtagcagccgcagaactggatcaagttgcgaattggtggtttgtggatgcgttatttatggacaaatgggagtttcttgataccatgaataaatccaaggaacacgggtttctgggttttcgcaataccgttaaatccttcggcacctggattgataaattacgtctgtataaaattgtgccgagttgtcgtattgtgtcaagtctg

SEQ ID NO: 1807 - DNA, 795 bp, Phaedon cochleariae
atgtggttcaccaatatacttgtggttctgattgttggcgttgcgctggttaagtcgtcgcacgcgcagccatatacctttccggatgacttcgtattctgcgacttagaatcaccggacttatctacgtgccttcgcgacaaacttcaaaactggacgaccatgctgggtacgcgcggcatcaaccacccgattcggtttacattggaaccaatggtaattgatttctgggtgcttaatatgaatcttaacttcctgaacagcacggaatatctgtggaattgtacctttagccagttctggaatagcacggtcattagtgctagctacaatccggaaaattacacgttggtctacactagctattacccgcacataatcgaacacggccgctatcagatgttcggtacagtatcattcgaagatggcagtgtggatgcaatatacggcaacggcccgtacgataaacacatatacggcctgaatctaacccacaaaatcacattcgttccagtcctgcgggagcatggtgtcgaatacctgcaggtttcacgttatgagctggattcagatggatttcgcgataccagcttgcaatggcataatttatacaatggtgataccattcgcggcaatcgtaccgtcactcgattagcgcacaatgcgatggcgctcggtggcgcacttgcaaaaccgtttaccgatatgaccatagctatgttccgcctgtacactgaaaacctgatttcgagcgtgccccgccgccagctgaggcgtcatttctcacgccacccg

What is claimed is:

1. An engineered microbial cell, wherein the engineered microbial cell is capable of producing nepetalactone, wherein said engineered microbial cell expresses an active nepetalactol oxidoreductase (NOR) having at least 90% sequence identity to SEQ ID NO: 605.

2. The engineered microbial cell of claim 1, wherein the engineered microbial cell further expresses a non-native polypeptide having an activity selected from the group consisting of a geraniol diphosphate synthase (GPPS); a geranyl diphosphate diphosphatase (geraniol synthase, GES); a geraniol 8-hydroxylase (G8H); a cytochrome P450 reductase (CPR) capable of promoting regeneration of the redox state of the G8H; a cytochrome B5 (CYB5) capable of promoting regeneration of the redox state of the G8H; an 8-hydroxygeraniol dehydrogenase (8HGO); an iridoid synthase (ISY); cytochrome B5 reductase (CYB5R); and nepetalactol synthase (NEPS), or any combination thereof.

3. The engineered microbial cell of claim 2, wherein the engineered microbial cell expresses non-native polypeptide(s) having an activity comprising said nepetalactol oxidoreductase (NOR) and a nepetalactol synthase (NEPS).

4. The engineered microbial cell of claim 1, wherein the engineered microbial cell expresses non-native polypeptide(s) having an activity comprising an 8-hydroxygeraniol dehydrogenase (8HGO), an iridoid synthase (ISY), saki nepetalactol oxidoreductase (NOR), and a nepetalactol synthase (NEPS).

5. The engineered microbial cell of claim 1, wherein the microbial cell includes a fungal cell.

6. The engineered microbial cell of claim 5, wherein the fungal cell is a yeast cell of the genus *Saccharomyces* and of the species *cerevisiae*.

7. The engineered microbial cell of claim 1, wherein, when cultured, the engineered microbial cell produces nepetalactone at a level greater than 10 pM of cell lysate or culture medium.

* * * * *